United States Patent 7,745,391 (HUMAN THROMBOSPONDIN POLYPEPTIDE) - sequence listing, part 27

SEQ ID NO: 63825 - DNA, 498 bp, Homo sapiens
gtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcaggtaagtgggctgcacaaggtgggcagacagggatatgtgtcttagtgtgtacctctgcaggaggaggatgttcatgtgtttgacctttcctagaaatttgttagaattgatctctcctaggttacaatgaacttcccctttgacaaatttggcccagattctgtggttggggagcctctacttctagaaatatcaaaataaatatgtttcattgttgtgaagatttaaaaataggattaaatttgtatctattttattaaatttgtatctattttatc

SEQ ID NO: 63826 - DNA, 1121 bp, Homo sapiens
gcaggaaagaatttgagcccctcccccagcctgaccatctctgttggttgctcggccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacagactcgcagggcaatgacattaaagtcactgctgagagcactggtgaacatgcctcctcactaccgctacctttgcatcagccacctcattggatggacggccttcctgtccaacatgctgttcttcacagatttcatgggccagattgtgtaccgcggggatccctatagtgcacacaactccacagagtttctcatctacgaaagaggagtcgaggttggatgttggggcttctgcatcaactccgtgttttcctcactttattcttgtaagtctttctctctcctaaggatgtcttctaaaagtttctggtctagcacaacttggatttgatatttctatgtgtatttcctactgtttaaaataccagattcttaataaatctatggacgtcaggaaaaactatcacctta

SEQ ID NO: 63827 - DNA, 388 bp, Homo sapiens
taataatgtccatcaatatatattggaaagccaactcagctccacattgcccctgcttttgcactacagcagcagagttgagtagttatgaccagggctgtataatccacgaagccaaaggtatttactatctggctggtcacagaaaaattttgctgacctgtgccctaaatgacagttccttgtaggtcaaatggtggttctgtgcttcctttgcagaggcagcaggccccaggaggggacccagacaacagcgtgagagggaagggcatggactgcgccaccctcacatgcatggtgcagctggctcagatcctggtcggaggtggcctgggctttctggtcaacacagccgggaccgttgtcgtcgtggtgatcacagcgtctg

SEQ ID NO: 63828 - DNA, 2349 bp, Homo sapiens
  misc_feature (1849)..(1849): n is a, c, g, or t
gctgaacccaaggtcttgcctcaaaatcaattcccccttccccctccaacacatacaccgcaacagaatgatacagctattgtgattgctaggagaagggctttgggcagtgcagtctcctgtttgcagtaacacctgctctttctgaagagctacatcagtaacatggtgggttttcctcacaacttaaaagtctgatcgtaacacattcatggaaactagaaccagcacacgaaaccattggcttgtggccctaaagaaataactctgtgtccagaaaatgccatgttaccaggttgcctacagctttgcctgtaacatgggcacaggctgggacatcagatagaagctggttcccatggtggctgggttgggatgggctaagttatgttgcagtaacgtacaacctcatcattttagtggctagcatgacgaagttttatttctcatgctacatgtctactgtggctttcccggtggctcagggttctcagagcccctggcagatggaggctccaccctgtgggacgtcaccagttgttatggctggggaaggacacactggaggctcttgctgctctgagccacaggagacatttgtcatatctgcacacagcccactggccctgcggcatcctaccacctgcccagaaggaggagaaccagaattactgctgagcagctcctctgcatgtgggtgcaatggcgtcttatgactctcagaaagctactctagtggccatctaccagtgtcacacagtgtcacgctcggtcatggcctgggaagatcagagtcacagagggataggacctggagtgtctctgaaaatagctgcctggtttcactccccggttttacgcctcttgagaagcagagtgatgcctagaatgagccctggactgggagggcacgtcccaggtttgaatcggggcctttgttccttttctgctgtatgactttggtcagatttctccttctgagaagtggagccaattaagcgatctccgatatgctgtaatctctgaaacatttcctcatatgtttctagcaacttccaacctgaggtctgatagacccagggttactttgcaagctaactgacatatcagtctcattgtctggtaaatctaattttaaccacttaatacttattttaggcttcacaaattattttaaaagaaaagataggggcataacaagaagaaagcttcggttacaatttccccgaaatgcctggatctgggattcctgcttcctggctgtgtggcagagaagatgaggatggccctggagtcagacgggactagggtccaagccccagctcttccacttgttaacaatgttctcagcctcagcttccttacctataccatggagacggcagtatttccttgtgggcttgttttaaggatccagtgacaggaagcatgcgaagctcttagaacagagcctggcactggtaaatagtcagtgagcagtagatgatattattaccatcctgtccctatccctgtcccccagcaaatattttggcttttaaatgttttaaatgatttcttgagaataagcaatgggtcagatgaaatctccttacctctcacctactggccatggcctaaatgtctgtagggagctggagccaggtgaggggagctgtggtttgggaagtgccgagttcattatgagcaagtgcacggtgctgggatgggctaggttccccgcacctcgccctgccactgcctcccaggacctgcctcttgctcccctgccacatagacagtctgcttgccccctgctttcagggacctcatggtccctgcccaatttaaagttcaaactctgcaactncacaaagttgcaggcttggcagctgtgggacctgggcttcagagactccaggttcctcggcccttgccccaggagggccctgctgaggtgaagtgggcataggagagagagtggacagagaatctgaatactgggtcacgttgcagttctgcgccttggaatgccataggctcccaggcccataagcccggcttcactaggcctgggtgtctgggttgtgaaatggggtgtctccttcccaggattgccgtaaggacctggattcatccaagcttaaagtaaattgctttgtaaggtgggagacaccgagtacaggcgagggactttattaggtcagggatttaatcaggcatctgtttttacagatttctttattcctgttccctcccctccccttcctgtcctttcacaataaagaataacaacttgacacagcttagagactaaaaatcatccttcaataaagcagcagaagttgcaaagtttcctatgatgctata

SEQ ID NO: 63829 - DNA, 370 bp, Homo sapiens
ctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaagtacaagtaactatcacacatgccctttgtcatattggtgatttccactgtttttctcccaaactgcagcttatatttgttctcttaatactgttgagcaaaaacttttaatttttataaagtcgaatttatcaatgttttctttaatggtttgtgtttattgataataaagaacactttgcctaactc

SEQ ID NO: 63830 - DNA, 376 bp, Homo sapiens
atcagcataaactatcatcagcctttctgttgcagtataactgctggactttcctcatttcccaaagtgaccctaaaatcaatcagacctgacctggggccagatcagacttccctgagctcggattctctgggcccaaattgtggttccaaacagctccagcccacagtctcctctctgcccttcatcacctcctaggtacatgtgagagactcagatctatggttttacatctgttctaaagggaattcaactcatcccaggggttggttcacacacataaaaacaaggaaactaagctcctaattaacatgtgcatattatttgtcttccacttcttgcaggatcacgggatcaaatgctatatatatatgag

SEQ ID NO: 63831 - DNA, 500 bp, Homo sapiens
tagccgggcatggtggcaggcgcctgtaatcccagctactcggggggccgaggcaggagaatcacttgaatccgggagtcagaggttgcagtgagccgagattgtgccatcacactccagcctgggggacaagagcgagactttgtctcaaaaaaaaaaagagagagagagacagattgcacactgggcagagctggggtttgaacacaggatcaagacctgggttcttcctctgccttctctacttcctcaacaaaattggtaggctgacaaaaattcttgcccagtagctggaaggcagcgtggattgtgaagaggagatctaaagggaaacaaataaatggtcctggaacaggacaaatgggcggcagaagagaatagccggcctctcagcccttcagctgattcctcctatatcaagggtcacagccctgctaccactgatggcagaagacaagtgcttgtggcatttatactcaaggatggctctttagagcccc

SEQ ID NO: 63832 - DNA, 343 bp, Homo sapiens
  misc_feature (79)..(79): n is a, c, g, or t
  misc_feature (161)..(161): n is a, c, g, or t
catttgtcaccctctacgctacaccataatcatgagccacagagcatgtatcatcctagccatggggacctcattcttnggctgcattcaggccacctttctgaccactctcaccttccaattgccttactgtgtccccaatgaggtggactattatttcngtgatatcccagtcatgctgaagctggcttgtgcagatacctcagccctggagatggtggggttcatcagtgtgggcctcatgcccctcagctgtttccttctcatcctcacctcctacagtggcatcgtcttctccatcttgtagatctgctctgccgagggccgacgccgtgccttctcc

SEQ ID NO: 63833 - DNA, 431 bp, Homo sapiens
tatgtatgtgtgtgtatgcagatatgggtatatatatgtatgtacaaatatatacatgtttaatgtattattacacatacagatatacacaaagagagaaaaatttgaagaattagatgaatatacgtataaagagaagttttaggccaggtgcagtagctcacggctgtaatcctagcactttgggaggccaaggctggtggatcacctgaggtcaggagttcgagaccagcctggccaaaatggtgaaacctcgtctctactaaaaaaaaatacaaaaactagccgggcatggtggcgcgtgcctgtattcccagctactcagaaggctgaggcaggagaatcacttgaactcgagaggtggaggttgcagtgagccgacatcgtgccatcacactccagcctgggcaacagagcaaaacgctgtctca

SEQ ID NO: 63834 - DNA, 1587 bp, Homo sapiens
  misc_feature (52)..(52): n is a, c, g, or t
tatccataaatattatttattataattattttaaaggttttttgtatatgcnggaaaataaaagcagatctttacctaataatatttacatagatttcaaaaggattaaagggcctaaatgggaaaggtaaatgtagaaagttaatttttttaatgtaggagaatattcttgaaacctaggactttcaaaagcacagaaattaaggaaaatgcttattaaatttctctcctcaaaattaaggatgcttattcaatgtgagacacagtatatgaatattaaaatcaagtacaggtgccaagacaattcaatgaaaaaagaacagtctgttcaacaaatagcaaatagtgctaagaaaactggatgtgcacatgaaaaagaatgaagttggaccccctactttacatcatatacaaaaattaacttatagtgggtaaaaggcctaaatgtaacagctaaaactataaacaactagatgaaatcatagatataaatcttcatgaccttgaaataggcaatggtttcttagatatgacatcaaaagcacaaggaacaacaaaaaataaatgaatgaattggaactcatcaaaatgaaaaacttttgtgtatcagtggataccatcgagaaagtgaagacaccaacatgggtgaacgtatttgtaaatcatatatctgatgagacttgtagctagaatacataaataactcttacaattcaacactttagaaagacaaataacccaattaaacaatgggccaaagtatctgaatagacatttttcaaaagaagacatataaatgcccaataggcacatgaaaagatggtcaatgtcataagtcattagggaaacggaaatcaaaacaacaatgagatattgcttagccaccagattggctacagtaaaaaagacagataataaaagggttgccaagggagtggagaaattggaaccctcatacattgttggtgggaatgtaaaatggtgcaatttatttggcaaacagtctggcagtttcccaagggtttaaacatagagttattatatgactcagcattccactcctagatatacaaccaagagaaattaaaacttatgcctacacataagcttgtacataaatgttcaaaacaacattattaataatagccaaaagtagaaacaatccaaaatagccattaatgaataaataagatgtgatgtattcatccaatggcacattatgtagccatgaaaagaaatgaataactggttcatgcaccaacatggatgacccttcaacatgttatgctaagtaaagttcgtttcaaaagaccacgtattgtgtgagtacactgacagaaaatgttcaaaatatgtacatctacagaaagtagattagtgattgcctagggctgaggagtttgggaaaaattggaagtgactgttaatgggtatcaggtatctttttgagattatgtaaatgtcctaaaaattgattgcagtgatagttgcacaactctctggatataataaaattcatttaactgtgctctttaaatgggtaaactgtatccattatatctcaataaagtttctataagaaatatc

SEQ ID NO: 63835 - DNA, 467 bp, Homo sapiens
tgtatctgtgcttttcagatttttccatgaactacagaaattcctgtggcactgctccctagggagttgttctaagctttaacagaaggcatcttagaataatgtaaaaggtcggggttaccacagtattaaagtatttgaactcttggtctgtcaggatgggagttgactttgttggccagcctggtctgcctgtaagattcatatcaggggttgtacgagttggaaaagcatctcctcatatcttttttattgaaagggagcttcctctggcagtgcagaaaatgattgcgtgaaaagtttgataattatatcaaaagaaaatggtggtagttaggttaaatggaagatgcttgtactcacatggtcccattaaaggctattctattgttttttttcatattttgcagtctccttaacatttaagaaactgaaggtgtatttaatcaatagtgtcactatgatag

SEQ ID NO: 63836 - DNA, 448 bp, Homo sapiens
tgccaactggaggtgaccttgccagtcaggatccaggggcttaacctactctaaccaacctttctttttcctccaatcttctgtggggttctccactgggcacgccccaaagccagggggcacagggagcgcgaagtaatttgtagaggtcagcctcctggggcagagggcaggcaggagaagtatttggagcagatgagggtatctggaggggaaaatgtaagacatcaggcacaatattgccctgtctaatggacagagtgattccaggttttgtagggactgaagctcacataattttgggggatctactttaagaaaaatcagctgggtgtggtggctcatgcctgtaattctagcactttgggaggctgaggcggggtggattgtttgagctcaggagttcaagaccagcctgggcaacatggtcaaaccctgtctctacaaa

SEQ ID NO: 63837 - DNA, 507 bp, Homo sapiens
atatttgacaaaattggggtttgataaagacaggtgaatactataaagccaataaaatggtaacaacatatttacagacaaaaaatattaagggctggttatagtatagcataatcacaccttgtttccaaaacaatgagagatagtattaaaggatttgctccaaaagtttgacagtgattatctatgattggtaagattacaggtaaccatatcctttttttctttttatctacattatgatgagggaaagctgttttgctaaaatggagagtataattttataaaaggaaagtaaacaatcttctaaaacaaaaggtacaggtattaaaggatacttaaaagtaacagttattgaccataaacaggatgagacatagatacatatatataaatttaaaaaacaaacactgggccaggcatggtggctcatgcctgtaattccagcacgttgggaggccgaggcagatggatcacgaggtcaagagatcgagaccatcctggcca

SEQ ID NO: 63838 - DNA, 332 bp, Homo sapiens
gtaaggtcatgtcaaagagacagttgcaaagtctactcctgataccctggggaattgcagggaagcgtcacaggcagagcccagtggcacatgaacatacatttgcttctccctctgaggttggcacctctcaggcgtgtgcaggagaaacattggataggtatgtgggaacccaaggcacatattcacccagatgccaacttggagaggagcaaagagtggcaaggtatttattcaaaagaagtaatcgagaagagactgaccaccatggtgctaattaacaagtttaaatttccctattccccatcagggtgggctcaagaggataattt

SEQ ID NO: 63839 - DNA, 151 bp, Homo sapiens
ggatcctccatttcagcctcgtacagagggaaaagagcaggagtacagccgtgtgatgacccgtaaagcttctgcttggatacagcacatatccttctgctcacattctattggccaaagcaggccacaaggacaagctgatgtcaattag

SEQ ID NO: 63840 - DNA, 728 bp, Homo sapiens
gcagaggctcccgcagtgacctgcgccgccttcttcaggtggaaccaaaaggtcccggaaccggagccaggggtccaagttttctccgttgcctttggaatatgtagtccaagccagaacagtcaggaccgcaggtaccggtgagaaatggagtccagaatcctaaaaacctacgagaaatacggcagcgaccacttggaccgcgcctcccacccaccgctcgagccccggagacttctgggagtggccgccttgcctcgagtgcgcatgcgcagatcggccactactgggcccctggcctgaggcttagggtggagttagtgcgttcttagggccagtaggaggcgagtctgagtagaaactgatccaggtagcctcggaagggatcacctgctggatgggtgtgagctcctcagggtggggcgccgaaaccttcatggctcctgaggtagagccggcctccttggtaacacatgggactgggacttttaataccacccgacaggcccagcttgtctcgtcaagcgctaagtaaatggactcacgtcctatatgagggtttgaagttccatcacattcttcaatacatgacattatgttcttcatctttggacacgaatatatttgactaaaaatttgactaaaaaatcatctgaagaaataactgctaaatagttttattatttttgttctggaataggcttcttgaagataaaataagaaattta

SEQ ID NO: 63841 - DNA, 546 bp, Homo sapiens
ggtttatatctcggaagaaaaaagtcgcaagcagctgaagcaccaaagcaaggaagacttgaatgcataaaagcagaataagtggaaaaatatgcaggaataataaaagcagatatctgataatcaggaaaactgagaccccacctctcaatctgcctggatctcctttccaagcaataagcccattccacagctgctgtgagtgttggctgacaactctcagctgctactttctctgctttatcacccccatatccagaccttggccaatgggtgattgaaatattttgattgaattaatatataatgttaggaaaagtaactttcattgtttcctcatccatgtgtaaatacctctcagctactggtcgcctagacgtcattatgacacaagcacattgctagatttttcaaactattttttgtaataaaaatgattcaaatctttcaaaagatagaattaattagcaaaagtataatctaaagaatacccttcctcattaaaattataataacctaataaaaggtaaatttacattgcaaaaa

SEQ ID NO: 63842 - DNA, 3720 bp, Homo sapiens
cgccgagccgggactgcgctagcccgccgcgctctgggctgcccgagcgagcgttcggacctcgcaccccgcgcgccccgcgccgccgccgccgccggcttttgttgtctccgcctcctcggccgccgccgcctctggaccgcgagccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63843 - DNA, 3746 bp, Homo sapiens
  misc_feature (3736)..(3736): n is a, c, g, or t
cgccgagccgggactgcgctagcccgccgcgctctgggctgcccgagcgagcgttcggacctcgcaccccgcgcgccccgcgccgccgccgccgccggcttttgttgtctccgcctcctcggccgccgccgcctctggaccgcgagccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaacctaaaaaaaaaaaccaaanaacacaagat

SEQ ID NO: 63844 - DNA, 3572 bp, Homo sapiens
tgcggctgcggcgctgcccggggtggctgcggccagagtctcccgcgcgcccggcggaccgcagcccgccctcgtcccccgctggcttttcgcctcctgcgagcccttccgcccggccccgctccgccgcctttccccggcccgagcacctgcacccagagcccgcgcgccgcccggagccgctggagccgccgctgcgaagggggtcccgcgtccgccgccgcgctggaagccaggcccgagcccctctccctcacactggcctttccccacaggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63845 - DNA, 3344 bp, Homo sapiens
gtgtcacctgggaagctcagctggcacctgccaccccctcccccatggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63846 - DNA, 3663 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggaccctgcagtgtctctccaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63847 - DNA, 2721 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63848 - DNA, 2225 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63849 - DNA, 1999 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63850 - DNA, 1889 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgagggcagggcctggccgggcggccaaggggccagggttggtgggggtgccacaggggtgtgactgccctccgggttcccccacccgaggggccctctgctccggcatcaccacagtgagtctgaggacgctgtgctgcccaggcacgatcaccgagccctgcacctctgcggcgccctggaggcctggccgggatgtctgttggctttggctccagggaccaagggaggcagccccagggagtgagagtctcccagcctcagg

SEQ ID NO: 63851 - DNA, 3642 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63852 - DNA, 3484 bp, Homo sapiens
agccactggtcacgggcagctgccaggctgggtctggacaaatgaggtctgggtccatcattggggatgggggccactgtcaggatgggagtctcgcctaaagctttggggtgaaggtgctgatgaccaagaggaaactgcggggtggggacatgtcagcaggggacgagaatgcatgacctaaaaggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63853 - DNA, 4264 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaacctacagcagggcgaggcctcggggggagagagaaaaaagaaaaaacaacaaaaacaaaaaacagaaagagaacaaaacaaaacaaaaaaagaacaacaaaaaaacagaaacagaagaaaaaacaaccagacaaataaaaaacaacaaagagaggcggcgggcgcgccgaaataaaaactctccccggaggggggggcccacaagttgcggcccacccgaggttttttgataaaaaagagggcgcgccccactagagggcggggcaataaataaagacagcaggagcgcgccgcgctctataacaacaccgcgtgtggggtgaggaacaaaaacagtccttcgcaggggagtatctttgtgaggacacaaccccccacaccggcggggggcgcgaccaccaaacagggggccacgcaccccccccgcaaggatataagccgccgccggggcaaaaacaaccaacaacgggcgaggcacagcgggggtaaaccacacgcgcccccgaactgggggcgggaagaaacagtcccatcgccagagaactagcggcacacattactgccaccgaccgggataacaaacctgcgactaacgagcaaacagacggcaacaggcagacaaaaat

SEQ ID NO: 63854 - DNA, 3713 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaacctaaaaaaaaaaaacaccaccaaaacaaacaaaaaaaacaaaaacacacacacccatccgggcatcactccagc

SEQ ID NO: 63855 - DNA, 2295 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcggctgtcacctgctcacagggatgctggtggctggtgagaccccgcactgcacacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63856 - DNA, 2437 bp, Homo sapiens
cgccgagccgggactgcgctagcccgccgcgctctgggctgcccgagcgagcgttcggacctcgcaccccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcggccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttctcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 63857 - DNA, 910 bp, Homo sapiens
cagggagtctccatcccatcgtcatgagatcagtggagagttcaggtggacattcagggacccaagatcttggtttcctggacccaaatatttctgtgactaacttgctggatgtttaccgagtttgtgttttagactaatgctctctccccgttattccctacagtctaatcagcctgccgtgtaagtctgtgtgaaaactgtaacaaaggtgtgaaatgattcatagtacgcataagccatgccttcagtctgaccgcaccctaagctagactctgcaccgtctacagcacgccaccctcctcgtcccctctcatcacccacctcgttccatgctgtgtgtgcgcattcccgtcgactgagccgtcctgtttactattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaagtgcgccaagtgcggaccggct

SEQ ID NO: 63858 - DNA, 4308 bp, Homo sapiens
cagggagtctccatcccatcgtcatgagatcagtggagagttcaggtggacattcagggacccaagatcttggtttcctggacccaaatatttctgtgactaacttgctggatgtttaccgagtttgtgttttagactaatgctctctccccgttattccctacagtctaatcagcctgccgtgtaagtctgtgtgaaaactgtaacaaaggtgtgaaatgattcatagtacgcataagccatgccttcagtctgaccgcaccctaagctagactctgcaccgtctacagcacgccaccctcctcgtcccctctcatcacccacctcgttccatgctgtgtgtgcgcattcccgtcgactgagccgtcctgtttactattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtgaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaagaa

SEQ ID NO: 63859 - DNA, 4208 bp, Homo sapiens
cagggagtctccatcccatcgtcatgagatcagtggagagttcaggtggacattcagggacccaagatcttggtttcctggacccaaatatttctgtgactaacttgctggatgtttaccgagtttgtgttttagactaatgctctctccccgttattccctacagtctaatcagcctgccgtgtaagtctgtgtgaaaactgtaacaaaggtgtgaaatgattcatagtacgcataagccatgccttcagtctgaccgcaccctaagctagactctgcaccgtctacagcacgccaccctcctcgtcccctctcatcacccacctcgttccatgctgtgtgtgcgcattcccgtcgactgagccgtcctgtttactattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtgaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaagcagaagtgggtcttgaggaataggggcgggggtaagaggggggggccccctaccacatttatttttcacaattgacaagggcggtctctcggtaaggaagaggagctggaaaaaggttccccggttttgcgcggcgaagaagtttttaaaaaaaagcggccaaagcgggggggggtaacggacggcgcg

SEQ ID NO: 63860 - DNA, 2535 bp, Homo sapiens
cagctgctttccccaaggtggtccccggatcttggcctcgtgccggcacgaggccaagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtgaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaagaa

SEQ ID NO: 63861 - DNA, 2864 bp, Homo sapiens
cagggagtctccatcccatcgtcatgagatcagtggagagttcaggtggacattcagggacccaagatcttggtttcctggacccaaatatttctgtgactaacttgctggatgtttaccgagtttgtgttttagactaatgctctctccccgttattccctacagtctaatcagcctgccgtgtaagtctgtgtgaaaactgtaacaaaggtgtgaaatgattcatagtacgcataagccatgccttcagtctgaccgcaccctaagctagactctgcaccgtctacagcacgccaccctcctcgtcccctctcatcacccacctcgttccatgctgtgtgtgcgcattcccgtcgactgagccgtcctgtttactattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactaccca

SEQ ID NO: 63862 - DNA, 2346 bp, Homo sapiens
cagggagtctccatcccatcgtcatgagatcagtggagagttcaggtggacattcagggacccaagatcttggtttcctggacccaaatatttctgtgactaacttgctggatgtttaccgagtttgtgttttagactaatgctctctccccgttattccctacagtctaatcagcctgccgtgtaagtctgtgtgaaaactgtaacaaaggtgtgaaatgattcatagtacgcataagccatgccttcagtctgaccgcaccctaagctagactctgcaccgtctacagcacgccaccctcctcgtcccctctcatcacccacctcgttccatgctgtgtgtgcgcattcccgtcgactgagccgtcctgtttactattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtc

SEQ ID NO: 63863 - DNA, 1164 bp, Homo sapiens
ttaaaaaacatgctggctcaaaccatcctgttcacgaatcatttcgatacaatatggccttcctgaggttcgggaccacgggcccatgaaacacagaaatctgttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaagaa

SEQ ID NO: 63864 - DNA, 3996 bp, Homo sapiens
gaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtgaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaagaa

SEQ ID NO: 63865 - DNA, 2909 bp, Homo sapiens
tgagaccacagctggcctctaacccttgttgtccttgggccctgacaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtgaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattctttttatatctgagtccttaatgatcaggaaatggattacaaacaaacaaaaacagttgcaaacagcaattaaagcattactagagaagcagtaacatgtctgttacctacagtctgtttgctcagatttttatagatttccaccaacagctggaaatgtaatatttccattccaagctgtctgacagcttgactcttcttcctacactgggccatttagaaccttcaacctttatgaatttcacttaatttgcttcattattaagtaattggtagtttccagattcctgaaatatttgaatccttgagtttaatgccaaacacttttggggtggtttagatgaactctgactctattttatttcaagtaggtgctatatcccggccataaacccctatagaaaagccagaaagttgtgcttcctttgaggctattagggggctctgtggtgttttaggatgggtgtgggtaactcatctacctaaacttttaatttctttacaacattcagcaagagagggggtcagtagtctctatctgctaataaatgaagaaaggaagtaaactctgaaaaataataaacatgtttatactctcattttaggtattatttttatttctgaagctggatgctcaaaaattaaaacgtttataagtttctaaattaaacttaatttataaaagaaaaaagaa

SEQ ID NO: 63866 - DNA, 2545 bp, Homo sapiens
cagggagtctccatcccatcgtcatgagatcagtggagagttcaggtggacattcagggacccaagatcttggtttcctggacccaaatatttctgtgactaacttgctggatgtttaccgagtttgtgttttagactaatgctctctccccgttattccctacagtctaatcagcctgccgtgtaagtctgtgtgaaaactgtaacaaaggtgtgaaatgattcatagtacgcataagccatgccttcagtctgaccgcaccctaagctagactctgcaccgtctacagcacgccaccctcctcgtcccctctcatcacccacctcgttccatgctgtgtgtgcgcattcccgtcgactgagccgtcctgtttactattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaagcctttcgtagttcagtaattgccagcaatataacacggctaaaatgaagtttttacagtatatgacatagtgcgcttcagctggttcatctggtgctccagggctcctgtgatctggatggagctcgggca

SEQ ID NO: 63867 - DNA, 1388 bp, Homo sapiens
cagggagtctccatcccatcgtcatgagatcagtggagagttcaggtggacattcagggacccaagatcttggtttcctggacccaaatatttctgtgactaacttgctggatgtttaccgagtttgtgttttagactaatgctctctccccgttattccctacagtctaatcagcctgccgtgtaagtctgtgtgaaaactgtaacaaaggtgtgaaatgattcatagtacgcataagccatgccttcagtctgaccgcaccctaagctagactctgcaccgtctacagcacgccaccctcctcgtcccctctcatcacccacctcgttccatgctgtgtgtgcgcattcccgtcgactgagccgtcctgtttactattgtgttttacaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagaggttgcctagtgaaaggaacctctaaagaaaacatgaaaagtggaagaaagagggaaatgggaagttgggagctttgtgctgtaatttatccagacagcagcgaagtatatttttcaattttaaaaaatccaggggtgatgagattacggcataaatctactttgtatctggtagtaacagtacgtttccaaaagtccttctacctgagtaaattgagctgtgagtgagtcgggaaatcagagatgtgcaaagggaagatggaacc

SEQ ID NO: 63868 - DNA, 601 bp, Homo sapiens
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacaggtgggcctctgcactgctgttggcaccttctggctcccctgaggctgagtgggcatgggcaagctgcctttgccagtggatgcgggatggtggagcccttttttgaaggcgtgtgcttccgagtgggtggtttagcaatggtgatgataaaaataggatgctgccattttcaaaatgaaagacaaggtagaaaggtgcagtgaacatggaaatcacctcgcatgagaccgcccgcaggtaccagcaccagcatggtggtg

SEQ ID NO: 63869 - DNA, 1801 bp, Homo sapiens
gccaggcacttccggcggcgcgctgcaggcgcggggaacaccaatggcggggtgagctgggcgctgctgctgcgcgtgcagacagcgggagtggttgggggtccgcccggtcgccttcctcggtcctggcctcggggctgggtgccgagcgctgggcaccgtccccgcactcagcgagcgcgacaggggcgaggccaggattccgggtcgcagttccccgggaggagggcgccctcaggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63870 - DNA, 2783 bp, Homo sapiens
gccaggcacttccggcggcgcgctgcaggcgcggggaacaccaatggcggggtgagctgggcgctgctgctgcgcgtgcagacagcgggagtggttgggggtccgcccggtcgccttcctcggtcctggcctcggggctgggtgccgagcgctgggcaccgtccccgcactcagcgagcgcgacaggggcgaggccaggattccgggtcgcagttccccgggaggagggcgccctcaggtctccaggggcagggccggcggggccgtggggaggccggggccggcggcggagtccaggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatggagtctcactcttgcccaggctgcagtgcaatggtgtgatctcggctcactgcaacctctgcctacctggttcaagcgattctcctgcctcagcctcccaagtagctgggattacaggcgcccgccaccgcacccagctaattttttctttttgtttttttaagtagagacagggtttcactatgttggctaggctgatctcgaactcttgacctcaggtgatctgcccacctcggcctcccaaagtgctgggattacagatgtgagccatggtgcccggctactcttaatgatgtattgacatctttccccaacagcacagctaaatttccaagtcgcataagccctggggctttcctggtggccccactggggctgctccgtccggaacctagaagaggcttcatggccagggctatggattctttgctctggatgaagctgagacacagttttcatctgttttgtatcttagggttttgagtaagattttctatataaaaaggttctcctgaataatgagatcagccaaccgcccatgcaactgaagacactgtcgtcattgggaaagtttcatcctattccatgtagtgcttgcaccgtaggttctttaaccagctccctcactgtggcatcaaggttgcttttggcttttggctgggatgcgtgtgctgtggtgaatatccttgccatttatgtttcctgctgtaaagccagggtagctgcatgcactggcatttgaacagggtgagacagtccacccagagctctcccaagtctctcccaaataccttagagtagggacactggtccccatttattggtgagaaaacaggctcagggtttcatgacttgttgaaagtgcagaaatggaatgctggccccctggatctgcacatctgcctcgctgctggtttgcgatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63871 - DNA, 2506 bp, Homo sapiens
gccaggcacttccggcggcgcgctgcaggcgcggggaacaccaatggcgggcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatggagtctcactcttgcccaggctgcagtgcaatggtgtgatctcggctcactgcaacctctgcctacctggttcaagcgattctcctgcctcagcctcccaagtagctgggattacaggcgcccgccaccgcacccagctaattttttctttttgtttttttaagtagagacagggtttcactatgttggctaggctgatctcgaactcttgacctcaggtgatctgcccacctcggcctcccaaagtgctgggattacagatgtgagccatggtgcccggctactcttaatgatgtattgacatctttccccaacagcacagctaaatttccaagtcgcataagccctggggctttcctggtggccccactggggctgctccgtccggaacctagaagaggcttcatggccagggctatggattctttgctctggatgaagctgagacacagttttcatctgttttgtatcttagggttttgagtaagattttctatataaaaaggttctcctgaataatgagatcagccaaccgcccatgcaactgaagacactgtcgtcattgggaaagtttcatcctattccatgtagtgcttgcaccgtaggttctttaaccagctccctcactgtggcatcaaggttgcttttggcttttggctgggatgcgtgtgctgtggtgaatatccttgccatttatgtttcctgctgtaaagccagggtagctgcatgcactggcatttgaacagggtgagacagtccacccagagctctcccaagtctctcccaaataccttagagtagggacactggtccccatttattggtgagaaaacaggctcagggtttcatgacttgttgaaagtgcagaaatggaatgctggccccctggatctgcacatctgcctcgctgctggtttgcgatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63872 - DNA, 1583 bp, Homo sapiens
gccaggcacttccggcggcgcgctgcaggcgcggggaacaccaatggcgggcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63873 - DNA, 1945 bp, Homo sapiens
  misc_feature (51)..(51): n is a, c, g, or t
caccgaaaatgtagtgaggcggcaccggttgtaatttcatgaggggctgtngtatctttgctacatcatggcagttggcttaccatgtcgcataagccctggggctttcctggtggccccactggggctgctccgtccggaacctagaagaggcttcatggccagggctatggattctttgctctggatgaagctgagacacagttttcatctgttttgtatcttagggttttgagtaagattttctatataaaaaggttctcctgaataatgagatcagccaaccgcccatgcaactgaagacactgtcgtcattgggaaagtttcatcctattccatgtagtgcttgcaccgtaggttctttaaccagctccctcactgtggcatcaaggttgcttttggcttttggctgggatgcgtgtgctgtggtgaatatccttgccatttatgtttcctgctgtaaagccagggtagctgcatgcactggcatttgaacagggtgagacagtccacccagagctctcccaagtctctcccaaataccttagagtagggacactggtccccatttattggtgagaaaacaggctcagggtttcatgacttgttgaaagtgcagaaatggaatgctggccccctggatctgcacatctgcctcgctgctggtttgcgatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63874 - DNA, 1886 bp, Homo sapiens
atatagggtaggtagaatgaggtactgatatgccctagtggtcttacctggttgccctgactgagcttcttgtaccggtggctaaatctagggttcatgctcatagtgagtcgtattatgctcgagaatccaggtgaaactgcgttactgacttctggcatatcttagggttttgagtaagattttctatataaaaaggttctcctgaataatgagatcagccaaccgcccatgcaactgaagacactgtcgtcattgggaaagtttcatcctattccatgtagtgcttgcaccgtaggttctttaaccagctccctcactgtggcatcaaggttgcttttggcttttggctgggatgcgtgtgctgtggtgaatatccttgccatttatgtttcctgctgtaaagccagggtagctgcatgcactggcatttgaacagggtgagacagtccacccagagctctcccaagtctctcccaaataccttagagtagggacactggtccccatttattggtgagaaaacaggctcagggtttcatgacttgttgaaagtgcagaaatggaatgctggccccctggatctgcacatctgcctcgctgctggtttgcgatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63875 - DNA, 1502 bp, Homo sapiens
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63876 - DNA, 1723 bp, Homo sapiens
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggagatggagtctcactcttgcccaggctgcagtgcaatggtgtgatctcggctcactgcaacctctgcctacctggttcaagcgattctcctgcctcagcctcccaagtagctgggattacaggcgcccgccaccgcacccagctaattttttctttttgtttttttaagtagagacagggtttcactatgttggctaggctgatctcgaactcttgacctcagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63877 - DNA, 1622 bp, Homo sapiens
agcggatattgaggaactgaggaggacgctcgggctgtacctgcagcgggggtcgggtgccgcttacacgaggtgcgggatgcacagcggtagacgtgagtagatcggtaaatccccagaggggcgtgaagcaaactagtgggctggacggcgatcagtctccagagacgcccagtgtcgtgaatggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63878 - DNA, 1711 bp, Homo sapiens
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagcaagcagtgatgtggtgtgtttattttcttttactcatctaggaacttgacgcagctttatatttaataaaataatagagattgcattattttaaggta

SEQ ID NO: 63879 - DNA, 1614 bp, Homo sapiens
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63880 - DNA, 2537 bp, Homo sapiens
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatggagtctcactcttgcccaggctgcagtgcaatggtgtgatctcggctcactgcaacctctgcctacctggttcaagcgattctcctgcctcagcctcccaagtagctgggattacaggcgcccgccaccgcacccagctaattttttctttttgtttttttaagtagagacagggtttcactatgttggctaggctgatctcgaactcttgacctcaggtgatctgcccacctcggcctcccaaagtgctgggattacagatgtgagccatggtgcccggctactcttaatgatgtattgacatctttccccaacagcacagctaaatttccaagtcgcataagccctggggctttcctggtggccccactggggctgctccgtccggaacctagaagaggcttcatggccagggctatggattctttgctctggatgaagctgagacacagttttcatctgttttgtatcttagggttttgagtaagattttctatataaaaaggttctcctgaataatgagatcagccaaccgcccatgcaactgaagacactgtcgtcattgggaaagtttcatcctattccatgtagtgcttgcaccgtaggttctttaaccagctccctcactgtggcatcaaggttgcttttggcttttggctgggatgcgtgtgctgtggtgaatatccttgccatttatgtttcctgctgtaaagccagggtagctgcatgcactggcatttgaacagggtgagacagtccacccagagctctcccaagtctctcccaaataccttagagtagggacactggtccccatttattggtgagaaaacaggctcagggtttcatgacttgttgaaagtgcagaaatggaatgctggccccctggatctgcacatctgcctcgctgctggtttgcgatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63881 - DNA, 2128 bp, Homo sapiens
gccaggcacttccggcggcgcgctgcaggcgcggggaacaccaatggcggggtgagctgggcgctgctgctgcgcgtgcagacagcgggagtggttgggggtccgcccggtcgccttcctcggtcctggcctcggggctgggtgccgagcgctgggcaccgtccccgcactcagcgagcgcgacaggggcgaggccaggattccgggtcgcagttccccgggaggagggcgccctcaggtctccaggggcagggccggcggggccgtggggaggccggggccggcggcggagtccaggtggggggcgcagcgccggggcccagatccaaggcgccgggggcgagcccggggcgggatttcgcttctgggccgggtagctccattgcccgcgcttcctgggctgtcgagtgggccctggcccccgggaccggcttgtgccattttcccgggagaccccttaagcgaggggaagacagcgactcacggtcagcagtcagtgcctcctggcttgtcagcacgctttggtgttgcagaagctagaagctttggccttggagccatgagggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63882 - DNA, 1741 bp, Homo sapiens
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggatgaaaggcctcgacatgaattcatatcgagcgccttcatcccccagcttgggctagtaactggagctcttctgacttgaagcaaagggttcttgttatgcagggctggggaaaggcagggcaggctctgccctgtgggaagaggtgggatgtgtaagaatggcatgaaggcactggatatgaattcatgtccagtgctttcatccccaaaagctacatttggataaataaaacatacagtcttaaaacacctgatttctgttggcagtaaagagtgcagatagctgcctctcacagacactcatggagtgtc

SEQ ID NO: 63883 - DNA, 1770 bp, Homo sapiens
gccaggcacttccggcggcgcgctgcaggcgcggggaacaccaatggcggggtgagctgggcgctgctgctgcgcgtgcagacagcgggagtggttgggggtccgcccggtcgccttcctcggtcctggcctcggggctgggtgccgagcgctgggcaccgtccccgcactcagcgagcgcgacaggggcgaggccaggattccgggtcgcagttccccgggaggagggcgccctcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtgaggatttcttgtgccattttcataatggtcattagctccttttaagctagaaacgtagcctgagctcctgaagagttcctgggagatttgagctgattttggagatggagcaggacaagtggggagtctctctctctctttctctctctctctttttaaccaaaaagagatgacaaaactaagttcaggggccatggaaaatgaaaaagtccgctatattgtgatttgggaagagaaagttatcaagagaaagaggtgaggatggaaggatggagaaaaacagactgtgggaaggatcagaaggaatccgccgaggcagggatgggtgtgcccatgtgtgccttgacgggacttcatcttatagactgttaaactgtcacacacaaacaggctttccacccctgctctgagagcaccacgcacagatttccagttcttagtgtggctgtttaaagtagaaaatctgggggctgggtgaggccactcatgcctgtaaacccagggctttagaaggctgaggctgggggattgcttgaagtcaggagttcaagaccaacctgggcaacatagcaacaccccccatgtctacaaaaatgaaaaaccaaaaagcaaaccaaaagaaaaatctgaaatttccatctggggattaacttctgtctttctggtgaacaatatagcaattcacgcattcttcaagcagcaaaagttcccggaacaattagggaagacgtatggtctgaatttatccaggcagtgggtctgctttggtttttgctggaaatttatatcagtgtctgggctcccaagaacataaatgtaattgccaaagca

SEQ ID NO: 63884 - DNA, 1452 bp, Homo sapiens
  misc_feature (1266)..(1266): n is a, c, g, or t
  misc_feature (1268)..(1268): n is a, c, g, or t
  misc_feature (1285)..(1285): n is a, c, g, or t
  misc_feature (1287)..(1287): n is a, c, g, or t
gccaggcacttccggcggcgcgctgcaggcgcggggaacaccaatggcggggtacttgaagctggtgtgtgtttcctttcagcgtcaagggttccacactgttgggagtcgctgcaagaatcggacaggcgctgagcacctgtggctgacccgacatctcagggacccatttgtgaaggctgcgaaggtggagagttaccggtgtcgaagcgccttcaagctcctggaggtgaacgagaggcaccagattctgcggcccggccttcgggtgttagactgtggggcagctcctggggcctggagtcaggtggcggtgcagaaggtcaacgccgcaggcacagatggagtctcactcttgcccaggctgcagtgcaatggtgtgatctcggctcactgcaacctctgcctacctggttcaagcgattctcctgcctcagcctcccaagtagctgggattacaggcgcccgccaccgcacccagctaattttttctttttgtttttttaagtagagacagggtttcactatgttggctaggctgatctcgaactcttgacctcaggtgatctgcccacctcggcctcccaaagtgctgggattacagatgtgagccatggtgcccggctactcttaatgatgtattgacatctttccccaacagcacagctaaatttccaagtcgcataagccctggggctttcctggtggccccactggggctgctccgtccggaacctagaagaggcttcatggccagggctatggattctttgctctggatgaagctgagacacagttttcatctgttttgtatcttagggttttgagtaagattttctatataaaaaggttctcctgaataatgagatcagccaaccgcccatgcaactgaagacactgtcgtcattgggaaagtttcatcctattccatgtagtgcttgcaccgtaggttctttaaccagctccctcactgtggcatcaaggttgcttttggcttttggctgggatgcgtgtgctgtggtgaatatccttgccatttatgtttcctgctgtaaagccagggtagctgcatgcactggcatttgaacagggtgagacagtccacccagagctctcccaagtctctcccaaataccttagagtagggacactggtccccatttattggtgagaaaacaggctcagggtttcatgacttgttgaaagtgcagaaatggaatgctggccccctggatctgcacatctgcctcgctgctggtttgcggnanccagtctctgtggtcgngnggggggacctctccccttccccggaagggcgcttgtgggctcgtgggtggtgcccggacccaggaccccggggtccgcagggcgtgtttgccggccagcggggtcgccctcgcgtggtcggccttgcccctctgggctttttggtcctgagggagcccgtcgccg

SEQ ID NO: 63885 - DNA, 202 bp, Homo sapiens
  misc_feature (174)..(174): n is a, c, g, or t
  misc_feature (178)..(178): n is a, c, g, or t
gccacagagacagagacaaggaaagatagaaatattaatagaaagagacccagagacgcaaagcaggggaaatgaatagagactcagacagaactactcagagacgccgagacgcaaccaggcagagaccttgaaggtgctcccccagattgatattgtgaacatcagcgacantttnagatgacctatagattcttttccc

SEQ ID NO: 63886 - DNA, 394 bp, Homo sapiens
  misc_feature (134)..(134): n is a, c, g, or t
  misc_feature (139)..(139): n is a, c, g, or t
  misc_feature (294)..(294): n is a, c, g, or t
  misc_feature (379)..(379): n is a, c, g, or t
gatctgcctgcctcagcctcccaaagtactgggattacagatgtgagccaccttgcccagccggggattagtgcccttataaaagagaccccaaaaagcgtccttgccccttctgccatgtgagctagaggacngtaanctatgaactaaaaaatgggctctgaccagacaccaaatctgcaagcaccttgattttgcaccatccagcctccggtaccattagaaacgtttctgttgtttataagctaccctgtctatggtattctgtagcgacagtgcaaacaaactaagacncggaccttccaacacaagttaaaggcttcaggggatgctgcctgggtcaacaacatgacagcaacctttactcatgagagacttngagtcagaaccacct

SEQ ID NO: 63887 - DNA, 442 bp, Homo sapiens
tgatgactcatggcttggctctctaaagttcaaccttctatacacaaaccatcggtcacagacagttatcagttatatggccaccctaatttcaaaagagagaagtacaatcccaccatgtgctcacagaggggagaactgtaagtatttgtgaagagcccaagtgcccaccagcccttccttaatcctccctcacttggtacaatagcgggactctcagggaaaggtactgcctccgatgtctctgttgggttgtctgcctgccttacctctttaaaaatactcctgccatcttagagagcaaatgggtaatacaaaataagaagttatatttattccttttagaaaacaaaaggaagaagtatgtagttgagcaaaggttgaataaaaatcacaaattttgtgtttagaggtaattaataaaaataatattatcttcctt

SEQ ID NO: 63888 - DNA, 302 bp, Homo sapiens
cagaaatccattctcattcccgaataggaaataaggccatacgctcagagtttcctctcctgaacgagacgctagcaagctcagaacatgagtaagcccaggtgctccagaaagatttaacaggtcttctcacagctaagctttagaagttcgagtatttccttgatatgggaatttcaaaggtctctaacaagtttctatagttattacttgttgcatttttagaatatgggctaattgctttatgtggtcttttggttgtgctctagaatctgatatgcctcaaacagtagctttccatc

SEQ ID NO: 63889 - DNA, 935 bp, Homo sapiens
attggccaattacaagataaaaatgttcaatttctttaagaatccttgttgacttgtcttttcatctctgctatttatatttgtcactgtttcaacaaagtcttattgctgaggaaggacttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaatggttggaagtttgaaactgattaacagatttgcatttgaagtgactccagacattaggtccagacattagttaaaaatagaaagaggaataaagacatctcttctctctagaaaagataacaccacaattaataatccttcccactttcattgagatcagcttgtctgataacctgatatgagtgtgataatgataaacatgataatagtggtacttttgtaattttgctggtgcatttaagaagatagtaaatgatgagttcatcttttcttcgaacattcctattcctagatgtagtttacctcaaatggggaattataactgtctaatttttgttgtgtacctgatgccccttttgctttaataccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagtccaaaaaaaaag

SEQ ID NO: 63890 - DNA, 321 bp, Homo sapiens
cttgctttttagtagctttaggttacttctctaccaagatttggagaaggtttattccatttattactggaaaacatgaaagcaaaatttatcaattttcacttcccacaagaaacctaataggccatcctttgatgtatcttaataagaacttccaagtgtaccttctaggcattttcttcatgtctttcaatattaaaatacttagagagttgggcttggcagtgcatgcctgtagtccccgttactcagaatgatgacgcaggaggattacttgcctgaagttcgagtctagcctggactagtgagtccctcatgtct

SEQ ID NO: 63891 - DNA, 268 bp, Homo sapiens
cactgcagcctgggtgacagtgagactctatctaaaaacagcaacaaaaaacaaaacaaacaaaaaaagagaagctcattccacagacttttggaggtttggggtcagacagtgacatcaggaaagtgatgttggagtggagggggcttgggagagggccaggtgtaaggcattaggaaatggctgaaggagggtgaatgtcaagggtctggagggaggagaatttgggactggatgaccagatctacggaaggcagaggggcctttg

SEQ ID NO: 63892 - DNA, 1216 bp, Homo sapiens
  misc_feature (1192)..(1194): n is a, c, g, or t
tgtgccatcagatgccactcttattcagcctatcttgaccttcagtttctttatctgcagaatgcccagtagtgtttgtaaggcttaagtagagacgatttacataaagtagctggcagatgataggtactcaataaataatacttgttattaatgcatttataacttatttttagttctattttcattactaaatagtccccttcttttccagaaaaattagaaaagtcagaagagcaataatgaaatggacattttgctgttatttctattaactaacaacagtgagttcgttgggtaattttacagagattcaaaaagtacattatgttggcttccttaaggtttgagataatcacaactgtaggtccaggtgagaaatctgggacacctcagacagtcagttaaagtgggtggacagaggccctgggtcacagtgagggcaaaagagggcaaggcaaatccaccctcacagggctctgcggttcctgctgctgttgggcaggagcagcagccgccacagacctgggattcaccattagcctagatacgggcacatgctgctccctggagtaggcgctgctgccccatttagcacagaaggactgctacaggatttgtccaccttgttaaacatgtagaaggatcacgacagtccagctgttgctcagatagacacagatgaagatggaagtgagtgtgaggctgagtgctgccctggcgagggcagcactgggagcccagcacactccccagacatgctcacacctgtgtctgcttttccctcctgagtgatacaagtgggtgggaaacgtggggattgttgcccggacccccttcaatatttgggcaccagctgccatgacctcctgtgaagctgggtctggagatgcgcatttctggctggagcctggtctgcctggaaactggagatcggcagccacgttttgtgggccgtgtttaagtcccggttctgccggcctgtcagcttcatgtcctccactccctcaggagcactgtgggtatgagaggacctgcctcacagggtggtggtggcctgggtagtggctgctgctgctgcccctgtgtgttgtatgtttatccattgtatgtggacagaggccctgggtcacagtgagggcaaaagagggcaaggcaaatccaccctcacagggctctgcggttcctgctnnngttgggcaggagcagcggccgc

SEQ ID NO: 63893 - DNA, 377 bp, Homo sapiens
gaatctcttaaatctcttaggaaacaaatttactaattaaaaagaaatataactttataaggatcaggcatgaatatcatacatgatatggtttgagtctttttccccactcaaatctcacctagaattgtaatccccatgtgtcaggggaggtacctggtgggaggtgattggatcatggaagtggttttccccagagttttctcgcgatagtgagttctcatgagatctgattgtttaaaagtgtttggcagttcctgcctctcttgtgctctctcctgccaccttgtgaagaagatgcttgcttttccttcacgttccaccataattatgttttctgaggccaccccagtcatgtggaactgtgagtcaattaa

SEQ ID NO: 63894 - DNA, 621 bp, Homo sapiens
ttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatagtcaaataaattatctgaaaagaa

SEQ ID NO: 63895 - DNA, 845 bp, Homo sapiens
ttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaagtagagacgggatttcaccgtgttagccaggatggtctcaatctcctgacctcgtgttccacccttcttgacctgccaaagtgttgggattacaggcatgagccaccgtgcccggctggaaactagcttatctttattttcttcatctattccaaggtgaggacacaccgttcctctgctccagaggatgcactacaaggcaccatcttaaaactagaggccaaacctgctgacacctttatcttagacttcccggcctccagaactgtaagagaataaatttctgttctttata

SEQ ID NO: 63896 - DNA, 484 bp, Homo sapiens
ttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtccctgatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatagtcaaataaattatctgaaaagaa

SEQ ID NO: 63897 - DNA, 835 bp, Homo sapiens
ttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaagatgcgccagtcttgctcccatcagcaccaatcctacctccatcgctaaccccactaaaacactcaccaagacctcaactcctgacccccatgcctcaggatactcctcaatagccatcgctgtagtatatccaaagacaaccatcattccccctaaataaattaaaaaaactattaaacccatataacctcccccaaaattcagaataataacacacccgaccacaccgctaacaatcatactaaaccccctgatgggacgaagactgggggatctctagacac

SEQ ID NO: 63898 - DNA, 597 bp, Homo sapiens
ttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggtaactatgctttgttttcatatgagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatagtcaaataaattatctgaaaagaa

SEQ ID NO: 63899 - DNA, 995 bp, Homo sapiens
ttcctgcatccgggcctgagagtgcaggcttgagggaagcatggaggtccatggcaagcccaaggctagcccgagttgttcgtcgcccacccgggattcctcaggagtcccagtgtccaaggagctgctgacggcgggaagcgacggccgcggaggtatatgggacaggttgctcatcaactcccaacctaagtccagaaagacctccactcttcaaacagttcggatagagaggagtcccttattggaccaggtacagacatttctcccacagatggcacgggcaaatgaaaagctaagaaaagaaatggcagctgcaccacctggtcgtttcaatattgaaaacattgatgggcctcatagtaaagttatacaaatggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaagtagagacgggatttcaccgtgttagccaggatggtctcaatctcctgacctcgtgttccacccttcttgacctgccaaagtgttgggattacaggcatgagccaccgtgcccggctggaaactagcttatctttattttcttcatctattccaagagttttctccatccctttactttgagcttctgagtgtcactgcatgtgaggtgggtctcttgaagatagcataccattggattttgcttctttatccaagttgccacactgtttcttttgattggggcatttagcccatttacattcaaggtgaggacacaccgttcctctgctccagaggatgcactacaaggcaccatcttaaaactagaggccaaacctgctgacacctttatcttagacttcccggcctccagaactgtaagagaataaatttctgttctttata

SEQ ID NO: 63900 - DNA, 401 bp, Homo sapiens
cccctaccaaatacatatttaacatttacatagtattttgcaggtggtttagataggtttactgatccccagaaacccatctatggaccctgcaaagctccaaaattagaaggaaggtggctgggtgcagtggctcactcctataatcccagcactttgggaggccaagatgggtggatcacaaggtcaggagttcaagaccagcctggccaagatggtgaagccccatctctactaaaaatacaaaaattagctgagcatggtggcaggcgcctgtaatcccagctactcgggaggctgaggcagagaactgcttgcacccaagaggcagaggttgcagtgagccaagatcatgccactgcaatctagcctgggtgacagagcgagactccatctcaaga

SEQ ID NO: 63901 - DNA, 477 bp, Homo sapiens
tccgcctcaaaaaaaaaaaaaatgtttataattgctcatcacaataaataatttattagaaaaatagttgcttatgtcataggtgaagtatttataacctgccttatttcattaaattcctctcactttgatagtttatgatctctgttggaaaacacaatgtatctcttgcagcacaggtaccatgcaggggatgtaggatggatgcctaagtaaaccataggtatggtaaagaagcactccaaagaataatgcttaccactcactcctcttcatacagataaaaaaactcccaacctgtttgctaagcccattagtaagtcttttgggttctacctccaaagacagttgaaatccgtatactacttttcattttctatcctggtccatttttttcttagccagagctactacaataaccatctaatctaaatggactccttgcactccattctccacaaatatgatacagattta

SEQ ID NO: 63902 - DNA, 581 bp, Homo sapiens
gttgggtgcacttacaagtaagtataaactgctcttcaattcaagtttattaatgctgccccaccccagggttttaatccggtctgggcagaagcgggcgataaaagccaaaggagaccataaagtgtaggatatttcctggttagtggctgccgggtaatcacgatgcatccatcttcctcggcgtcgcagccctcagtagccagaaggcagtctccttccctggggggcaaaagccccgagcccagcctgcccgttgccccgctcccgcggtggatgaacctcaacccttcccaggctccttcctggccccagggtcccaggacccccgagaccctggggtgcggcgccactgaggcccagaccgggggaaggagaccctgtcactcgggagcggagccctgtcccgggagcgcacggaaatgcctcctccacgctcccaaggttcctgctccgccaggcccaaccggaaggagtcctcgggccgcagtggggcaccaccgggccgccgggccctccaggctgcgtggggcctgcctcagtgggcaactggggagctagcccggggcggccgcaagccg

SEQ ID NO: 63903 - DNA, 156 bp, Homo sapiens
  misc_feature (11)..(11): n is a, c, g, or t
  misc_feature (13)..(13): n is a, c, g, or t
  misc_feature (15)..(16): n is a, c, g, or t
  misc_feature (136)..(136): n is a, c, g, or t
  misc_feature (138)..(138): n is a, c, g, or t
  misc_feature (141)..(141): n is a, c, g, or t
  misc_feature (147)..(147): n is a, c, g, or t
  misc_feature (149)..(149): n is a, c, g, or t
  misc_feature (151)..(151): n is a, c, g, or t
  misc_feature (155)..(155): n is a, c, g, or t
aagcttatgcnangnncatatcaccacgttatattgagaatgttaagtaagtaaattattcctttagtgtcctgaattcacatatggagaagaattacattttgggaatctttacttaacagagtatattcaagantntantggtantngntttna

SEQ ID NO: 63904 - DNA, 176 bp, Homo sapiens
ctaacgttaatagttaattctaggtgttgagatcagggtgtatagtgtatattattatttgtacttttctttaccttttatatttctcaaaatacattatgtcccttatgttgattaaaccatattctactaaccagtcaaaatattgaaaaaacctagtctttgctggaatttga

SEQ ID NO: 63905 - DNA, 343 bp, Homo sapiens
aagatttagaaattatttattgactttctaccgtggaagataaaatttaagaccaggccaggcacagtgtggctcatgcctgtaatcccagcactttgggaggcctaggcaagaagatcacttgaggccaggagttcaagaccagcctgggcaacataacaaaaccctgtctctacaaaaaatttaaaaattagccaggcatggtggcacatgcttgtagttccagctactcaggaggctgaggtgggaggatcatttgagccagggaggttgaggctgcagtgagccatgattgtagtactgcatttcgacctgggtgacagagcgagaaccaatatctaaa

SEQ ID NO: 63906 - DNA, 286 bp, Homo sapiens
cagaccttcaaggcaaagaccacactcaaggcagaatctgcagggccatccaagcagacaggctacaaacccatctccacaggagactctacagggagaccaatgaggacttaacctaggagcaagggtgaggaaaaactataccccatcctctgacttcttgcccccactcccaaccccacacatcatggagccccaatatcattgtgtggagaattcatctgcatatctacccaggcagccatccaaaagacagccgaagtcctgagctttagttctaatcctc

SEQ ID NO: 63907 - DNA, 1641 bp, Homo sapiens
gttaaataagttgtctttaaacagaaaaacataaaagaaggctatgtatttggaatgggttgacagaacgttgtgacttgaggctctttttaagttaacagggcatggtggcatgtgcccgtacttccaaagtagtcccaactgtttggaaggctgaggtgggaggatcatttgagcccaggagtttaaggctacactgagctatgatcactctactgcactccaggtggggcaacaaagcaagaccgctctaagaagggccaggcatggcagctcacacctgtaatcccagcattttgagagcctgaagttggtggatcacttgagcccagcagtttcaatagtaacttgggcaacatagcaaaaccccgtctctacaaaaacaaaacgaaatgaaagaacaaaaagattagccagttgtggtggtgcatgttgtagtctcagctatttgagaggctgagatgggagaattacctgagcccaggaagtcgaggctgcagtgagccatgattacaccactgcactccagcctgggtgacagaccgagaccctgtctcaaaccataaataaaaataaaaaagaagaaaaaaatcaaaagtgtatatattgtggtaggcagcttctgacatgttcccaatgatccctgcctcctggtattctcacccttgtgtaatcctgtccttctgaatgtgagctagacttaataacttgattttaacaaattagacaaaagtgatggtatatcacttctgtaattaggttttaaaagaccatgactgttattttgctgatgtgttctctctggctcttcttttgtgcttgctctgttgaagagggccacttgacaaagaactgaggtcagctaacttgccaatacccagcaaggaactgaggcccatagtccaacaatttgtgaaccctgccaacagctattgagtgagctcagcgatagatactgtcttagttgagtcttgagatgactatggcaccagcctacaccctgattacagtcttgtaaaagatcctggcagagcacttatataaacagtatgtagattcccatagaaactgtgagataataaaatttttttaataaaaaaaagtagagcagtttaggttgatagcaaaattgagaggaaagaagagaattcccgttatctcccctctgctcccacacatgcatagcctcccccattatcaacattcccaccagagtggcacataatacagttaagtatttgtatttacacattaaaacctccaaacacatgcttgagatggggtgtgcagtaataagcactactgtgttttaacctttggcagcttttattctttcctcccaactttcaattattttcttttcatttccaattttttaacctttctctacttgaaaatagtgaccagtttctttttggttatagtcatcctaatgtgtatgatgtaatatctcattatggttttggttttcatttccgtaatgaataatggtgatgagcatcttttcctgtgcttcttaaacattgtatattttatttggtaaaatgtaattcaaacccattgcccatataaattgtgcatatttgtctttttattgttgagttgtaaaagttctttttacatagtagataaaaaaaaaaa

SEQ ID NO: 63908 - DNA, 1339 bp, Homo sapiens
tggcattgggactgactccagcctctgctccgggaggccctcccgggctgcctgacctcccgggaccatgcagaaggcctcccacaaaaacaaaaaagaaagaggagtcagcaacaaggtcaaaacatctgtacacaacttgagcaaaacacagcagaccaaactcactgtgggtagcctgggattaggcctcatcatcatccagcatggaccctacctccagatcacccacctcatcaggaagggggctgcagccaacgacgggaaactccagccaggctgtacaggaagcatggctggggaggcctcaggaaacttacaatcatggcagaaggtgaagaggaaggaggtgatgttctgattagtgttggccatgccaatgtgttaggatatactcttcgagaatttttacagcttttgcaacatatcactattggaacagtgctacaaatcaaggtttaccgagattttattaacattcctgaagaatggcaagaaatatatgatttaatccctgaggccaaattcccagtaacaagcacaccaaagaaaattgagctggcaaaagatgaatctttcacaagcagtgatgataatgaaaatgtagatttagataaaagacttcaatattatagatatccgtggtcaactgtgcatcaccctgcaaggagaccaatatccatctccagagactggcatggatataagaagaagaaccatactattagtgtaggaaaagacattaattgtgacgtgatgattcacagagacgacaagaaagaagtgagggccccttctccatactggataatggtgaagcaagacaatgaaagctcttcctcctctacctcctctacctcagatgcattttggctggaagattgtgcccaagttgaagagggtaaagcccaactggtatcaaaggttggttagcaaatctgtggtcatatgagcatttatcttgcagacacccaagttttgtgcctcaccaggcacaagtttgctgtacttatcaaggactgtctgtagactcaccaattctcttctcttatgactgcgttataaagcctttagagatgttcttcaacaggattatctaaagacttccttgggttcttgcaggcctcacaaatcttattttcagaataagaccctcctttttgagaagaatttctttcttttagaaaatgccgtagagaaatccaatatcagaatgtctgaacatagtagagaatgtcactttatgtaaacactacatttttctttaaatatttagtttctctcttttttttggtaaacttcaagtactataattaaaataactaagagacataaaaat

SEQ ID NO: 63909 - DNA, 357 bp, Homo sapiens
tctgaaatttcctacagaaaatggccttctttcattgaaaaggttttaggcttacagctctgtgaattggaatttgaaagttgtcaatgctgtgttgatttactcgagttactgatgataggagccttttggtgtattggagctcttttggatgtacgtgcagaaacccaactgaaactgacgtaagccaaagtaaagaagtgatgtgttattgactcacataagtgaaaagtctggggtagggctcaagtatgactttttccagggttgcaaactctgccattataactggccccactgtttcttggcagtgtttccttcagtgttggcttcgtatgcaggcaggttttccccagg

SEQ ID NO: 63910 - DNA, 352 bp, Homo sapiens
aaactctctgattgtgtgcccaggtttcagggagcagggacagtcatgcagaaatgtgaccggacagaaggaaatgatgtaatggtaacaggctaactagggacactcggtgaggcctgtctgttcagatcttgctcagcctctctgtgtagctttccttcctcgcaggtatccggcaggaccctttctgtaatggggggcctattacctaccattaaataagataggtcagaaaattttttctggccaattcttacacagaaaaacagccaaaagtgaaagtgcctttaggctacacgttggctttggggaaaaggaactctggtttctgtgacactcgttggggcagaga

SEQ ID NO: 63911 - DNA, 536 bp, Homo sapiens
aagtaaaccacggaaactacatcatccaaacccgaaacgcggcaggttggccacaaatagagggctaatttgaaggacaatgaaattttaacttatccccagtgcctaccatttattagcgaatctcaagatagccgagaacatttattcttttcacatctatagtagcaatccccagtcaactccagactaacctgttaagtaccagagaataaacatcacagagacgctatagcctgggccaaatggcctggctccagagtctccagtagtctagaactacccaacaggaaattgttgctgacatttctgaagaaacctcttcacttggttttcttttttatacatctagatcttagaaatgaaaactccttggactccctggctgtcaaagaggcggcttgaacgtactcagcatcagaaaatgaaacatttgctttcactgtctgtttcttagtggaagaatcactccatggctgtcagttggcagatccatggttgcagctctctcattccatccctggatatgggccatg

SEQ ID NO: 63912 - DNA, 373 bp, Homo sapiens
ttggtcctcaagtcctattttaaaattttgtcaattagaggactcttggttctcttggttgactcattctctgctgatttgttctctgtacttgcagcaaataaagtgcagtcattgagaatgttcctgtgtcactgtgatgtatcaagggatcttcatgttaatatctgtttctctgacaactgtgttttatactttgtactgtagctttcattggagaagccctgggctcataagagtgatttgttgtggcatttccttatggaacataagctttgaaatatacttgagataaatattcatgggagacatccaaatgcagtaatgagagtacaatgaagacagcatttggacttggaaaacctgagttcaa

SEQ ID NO: 63913 - DNA, 649 bp, Homo sapiens
gagataaatagatagtttgagagaaattaagcagatagaatgactaggacttggcagttgactggatatggtgggcctggtgaatgagaggcaggagtcaagattgatggtcaggtttctgacttgggcagtgggtatatagtgatgcttgtacgaagattgagaaagtaaaagggaaagtaaatatcaagcagtttcaagcagcagtcagctgctgggctggctcaccacacttctgtagattccgttgaaaaggagacaatgagcctagatagatttagacagtttattactcaaagcaaagtaggcagcatgatcttcatgcatctatgaattccccaaatcccatgatacagagtgaggcccagacagatgctgtgtacacggtggacctgtgtcctcccaatcttataagaggctacttgcaaacttgcccaaaatcattgtcctggaggttgacattatctttgttatgctggtcaggaaacaaatgtaccctctaacccagaagcatatcctgtctttactcagagacaaataaaaacaccatggacaattacctttcaacagtaagagaatgctttccattttggacataatgaatttgaaatgcccatgatatctaaataaaggtattcagtagataata

SEQ ID NO: 63914 - DNA, 369 bp, Homo sapiens
gacatcctagatcctttaagtcctccctcaatctcatgtagtgggtattcttttgagcattattcagaggagataatttgcccaaagccagacaagtattaagtagcagagtcaggatccaattccagggctgtctgatttcagagccttttagctaccctgctaggtcttgcaatagtaatgggccctctcattgcttacctgtcaggccttagaattcttagaatttagctgcctctacaccattgtcttggttctcactccagggttaggggctgcctggtcaacactgaggtctttaactgtgctgaagcattaggatagaaatttagtctaataaatacttactggatacctactacatgcaaa

SEQ ID NO: 63915 - DNA, 709 bp, Homo sapiens
  misc_feature (35)..(36): n is a, c, g, or t
  misc_feature (58)..(58): n is a, c, g, or t
  misc_feature (72)..(72): n is a, c, g, or t
  misc_feature (78)..(78): n is a, c, g, or t
  misc_feature (93)..(93): n is a, c, g, or t
  misc_feature (111)..(111): n is a, c, g, or t
  misc_feature (122)..(122): n is a, c, g, or t
  misc_feature (128)..(128): n is a, c, g, or t
  misc_feature (130)..(130): n is a, c, g, or t
  misc_feature (142)..(142): n is a, c, g, or t
  misc_feature (147)..(147): n is a, c, g, or t
  misc_feature (172)..(173): n is a, c, g, or t
ggctagaccctcctcagctccaaagtactgggatnnaggctgagcactgtgccggccnagaataatttttgnctcttngaaatcatgtttctnctctacatttcccccaanccgtgtacctngctacntngaaaatatcttngcttntaccatgatgtaactagatgcgatnntatttgtatttaccttgcatagtgttcagagaacctcttgactctgagttgatttcttccagcagtagcagtagctcttcaaatattgtttttgtccctttctctcctctcctggaactccatctaaaagtgtttttctaaatttcatatttagatcctcaatctgtctggaaataatcatgtaaaatctttttattttgaaataattttagacttacagaaaagctgaaggactagtactaagaattccagtatactctatcaagattcctcatatgttaacctgtcatgattatcacttccctgtatataccatgtatacacacatagtttttttgggggtgggggggctgtttcagcatgaactatagacataatgctcctttactgctgaatatttcagtgtgtatttccagaaaaacaaggacattcttttttataaccatagtaataacattgataggatgctagtatctaatgtataacctttcattaaattttgccagttgtgctaatttcagatatagcaaaagaga

SEQ ID NO: 63916 - DNA, 267 bp, Homo sapiens
gatcttttattaattcatctacaaagtggaggataatagaacctttcccgctgagctgttttgagaactaaacaccacaatgtttgtgcagtacctgcacagattgccgtagcagggtgtgcaatcagcaaagatttcctgaatcccaatctgacccattgtcgcatggcatggcaacttttcaactttcagaaaaacattgaattaaggcccttgcactattatttcaaagcacacgagtgcaattggatatgattttgaacacag

SEQ ID NO: 63917 - DNA, 261 bp, Homo sapiens
tgtgtggagctatttgttgtcaactgaacatccctgccaccccttctaatgtctccctgctccatggaagagaaatcaggactgtagttgtaatttgcagaattctcttctctgtgaggttcaggagagaccatccaggaagacgcacttgtatgaggaaggaggaaggcaaggccagtattctccagtggcagttgtaggcacacgcatggagagatgtaaggttcaaagcagctttcagatgaacttttggagaattgc

SEQ ID NO: 63918 - DNA, 514 bp, Homo sapiens
gaagaactgtaacactcactgtgagggtccgtggctttattcttgaagtcagtgagaccaagaacccaccaattccggaccctatggctcactgtaactttgaattcccaggctccgtagttccccctgccttagtctcctgaatagctgggactacaggcacacagaatcatgccaagctacctttttattttttgtagagaggaggtctcgctgtgaagcccagtttggtctcaaacaggtggactcaagagatcttcccacctcggcctcccaaagtgctagctttacaaatgtgagccaccatgtctggccacgaactcttccaatgagcttttataaaaaaaaataattcaactattcaatgtgagccaaggatgtgccagacatttgctagatgctatgaataaaatatgaccaagattcagtctttgttcctatggactttatagtctactagtagatgagactcataagtaatatgtagccaaaaataaaatttactatattacgg

SEQ ID NO: 63919 - DNA, 396 bp, Homo sapiens
gcctgtaataccagcactatgggaggccaaggcaggtggatcacttataacccaggaatttgagaccagcctgggcaaaagagcaagaccctgtctctacaaaaatttaaaaattagccaggcacagtggctcaagcctatagccccagctacttggaggccgaggcaggcagatcacttgagctcaggagctgaccagcctgggcaacttggcaaaaccccatcttacaagaaatacagaaattagctgggcatggtggtgcacacctgtagtccctgatactctggaggctgaagtggaaggatcgcctgagcccagggaggtgcaggctacagtgagccgtgatcatgctactacactccagtgtgggtgacagagtgcgaccttgtctcaaa

SEQ ID NO: 63920 - DNA, 301 bp, Homo sapiens
tgtacattaaactaccataaaccctgcttgtgggtaaccaaagcacatgtagtggtttaatcatgcaggacctttccaatttggtatggagggaactgcctgatctttcctgagctctcttttctctaataatcacttttgtttattctactcttacatgaatcgtaaaatgttagtaaatagaactatatatgttatagagatgaattccctaaaggccccctcgatgacaacactgtgatgtgtgctccatccttctcgatcctcttatcctcaccaacacttagcgtcagaggtttca

SEQ ID NO: 63921 - DNA, 4448 bp, Homo sapiens
  misc_feature (661)..(661): n is a, c, g, or t
  misc_feature (1130)..(1130): n is a, c, g, or t
  misc_feature (1706)..(1706): n is a, c, g, or t
  misc_feature (1780)..(1780): n is a, c, g, or t
  misc_feature (1793)..(1793): n is a, c, g, or t
  misc_feature (2071)..(2071): n is a, c, g, or t
  misc_feature (2197)..(2197): n is a, c, g, or t
  misc_feature (2264)..(2264): n is a, c, g, or t
  misc_feature (2808)..(2808): n is a, c, g, or t
  misc_feature (2821)..(2821): n is a, c, g, or t
  misc_feature (2828)..(2828): n is a, c, g, or t
  misc_feature (2854)..(2854): n is a, c, g, or t
  misc_feature (2866)..(2866): n is a, c, g, or t
  misc_feature (2868)..(2868): n is a, c, g, or t
gggtggaggaaggactggagcctggtcagttgccggtggtgaaggagaaccgtgatccctttgtcagagggtcttcagtgaggtgttcccctgatcctcgcatccaccccgtgacttccagcgttatcatctccgtcgctatcccaggaacacgggaggttcagaaggggaaagtgatttccctaaggtctcacaacccggtggtactttatgtgagcagcagatattttttcatttatcttttgattttactcgctggtagattttgccatgtatacgttttgacgttttaaatttctctcgggtggaatttactgttctttccgtttggggcacccaaaattcttcactactttgaaatacgaaagttttcccatgattctggtgcagtcacgctctgcgtaacagtgtttctgtcaacgagggacctcatgtaaatggtggtcctatgtgattgtaatactatatttttgtattgtaccgtttcttttctttactttcttttttttttttttttttttgagacggagtctcgctctgtcgtccaggctggagtgcagtggcttgatctcggctcactgcaacctccgcctcctgggttaaagtagtgctctgcctcagcctcccgagtagctgggattacaggcgtgagccaccgcgnccggccagacacaatttattgatgtaactgttcctctaaatactactttaactacatcactcaaatttttatatcttgtattttcttttctgttgttgttgtttttgagactgagtctcactctgtcacccaggctggagtgcagtggcactcagctcactgaaacctctgcctcccgggttcaagcagtcctcctggctgggattacaggcacccgccactacacctggctgatttttgtatttttagtagagacggggtttcaccatgttggcccggctgctctagaactcttgacctcaagtgattctcccgccttggcttcccaaagtgctgggattacaggcatgaaccactgcacccagcctttttattgtgttttcattaccattcaattcaaatttttttaacttcccttgtgacttcattttttacccttatttatttagattgtattgcataatttccnagtttttggagattttccagatcttttttttttttttttgagacagagtctcgctctgttgcccagtctggagtgcagtagcgagatctcggctcactgcaagctccgcctaccaggttcacaccattctcctgcctcagcctccagagtagctgggactacaggcgcccgccactacacctggctaatttttttatttttttttgtatttttagtagagacggggtttcaccgtgttagccaggatggtctctatctcctgacctggtgatccacctgcctcggccttgcaaagtgctgggatcacaggcgtgagccatcgcacccggcccagatctttttatattattgatttatagtttaattctgatttggtcagaatactgtgttacgaatttcaattattttaaatttgttgtggtttgtttttgtattgtatttttgtttcattttgttttagtagactcctggtctcaagtgatccgctgaccttggcctcccaaagtgctttacaggcgtgagccactgcaccaggcctgttgtagtttgttttaaggtcgaggatatgatgatctntctgggtaactgtttcgtgtgtatttgaataaatattgtgctgttgatcgtagaatcttccttgattgattgantgattgagacagngtctgtctctgttgcccaagctggagtgcagtggttcagtcacagctgtctgcaacctcaaaccttttgcctcagcctcccgagtagctaggactgcaggtgtgcgccctaatccttttgcctcagcctccggagtagctaggactcaaggtgtgagccaccacactcagctaattttctgtattttttgtagagacgaggttttgccatgttgcccaggctggtctcaaacccctgggctcaagcagtccacccacctttgcctcccaaagtgctgngtttacaggcatgagctactgtgcctgaccctctttttccattcttttatcttttttttttttaatttcctgactcctacaactgatcatccttttactttgaatgtagctatgtttttatatttnaaacaaactgcttatagacagcacatggtttggtcttactttttttatataatttgacctctgttanttaattggtgtgtttatgccaattattgatatagttgtgttaaagtctaccatcttgctggtttttttctgtttttcttatttggtctttgtttctgtttacctttttttctgtctacttttgtcttaagtgggtcttttttataattacattttatctccactgttgtcttattgtatatttgtaaaaatttaacagagtttttggttgttaccctaaagtttagtggaactttaaagatatcatactgttttatgtcaatatacttggaacattatactcccaatttcatcctcccgtcttttgcattattgttgtcatacatgttgcagaatattgacatatgctgtaaacccacaaaactttgctactatttttgctttagataatctttcacagtgattaaaagcaagaaaaagtatctattgtgttgatcctcattttaacgattctcgagattttcatttatttgtgtagattcaggtttttgtctgatatcatatttcttctatttaaataacttcattaaacatttcttctatgnaggtctactgatnatgaatncgctatgtttttgttgtttgaaaaangtttttacttcntnatcattttgaagaatttttgctgggtatagaattctgagttaatagttttttgctttagttgcttttttgttgttgtgaaagcactttcaggatgtcactactttgttttctggcttagtttctgatgagaaggtggctatgattcattatcttgatttttctatatataatatgtcttttttcctctggctactttgaagattttaactttggttttcatttgtttggatatgatgtgtccatgtgtgtttttgtttgagtttagtttttggtattttccctgtttggataaattgagtttcttggacctgtggtttcaaattattatttttggaaaattcttgtccattatgtcttcaaatacttcttttctccttttggaatttcagttacatgtttattagaccatttgatattgtctcacagcccttggatgctctgtccttttatgtttttcttccatttctctttgagtttcagtttgacctatcttcaagtttactgaaacttttcttagctcctttgtctactaatgaacctgctgaaagatcaactctgttactgtacttttcttagcatttccatttgattttttcttgcagtttccatctctgctgaaattccctatttgtttattcatgttgtccaccttttctagtaaagcctttagtatatgaatcatagttgtgttaaatgccctgtctgataatttcagcagttgagggttctgttgattgttttgcctcttttgatagtggattatcttagtcttgcctttatgggtgtctgataatgttagattgaagataggtgctgttagtatgatcttttctgccccttctgaagaggcaaagggactttcccaggaggtggtattttcccaggtggtctctagggatttctaaacaagtcattctaggagttgtaaggcaggtcagacctttaataacaatgccttcctttttcctctattccagttctgccttcatagttctctgcctttgcccaaaactgcagaaaatgaacaaatcccaggtgagttgtttgtttattccccattttgcttttcagtgcatttaaggaagtttataaggatccagaaaatgaaatagaaaagtatgaataagacacaaaggaaacatagcaagaataactaatcaataccagcagccaaaaagcaaattgagttaattaaatgtcttgcattggttatgaataccaattatttggttctgtacattaggtctgaataaattttatggaccttcatatagatggtgttttggacagcacccccagaaacaaccaactttgaaagggttatcactttatctgtggttgtttcatataacattcctcagtgcaagtgcagaagattattgtatgtatttggtttttccagtcagattagcctaatgccagagaatgcagtaaatatgtgggtttgtatttaaatccccccaccccaagcaggtaccactgtcattactttcttgtgtagctttccagagcttatttgtacataattacacaagtacaaataaaagcacaaacgtaagatagcatgttaaaaaaaaaa

SEQ ID NO: 63922 - DNA, 374 bp, Homo sapiens
aaactcagatgatggtggcaggaatgcattctctaaagatttacaccttcctttaacatgaggtggtttacgtgtttgggttcagaagtcagagtgtctaggtttgttccaggttttgccgttcgttaactgagtgaccttgggcgagtcatttttttctgtttcatttttttctcacgtataaagctgtggacagtaatagtggttgtgaggattaagtgaatgaattcatgcaaagcacttcaaacaatgcttggcacataataaatgtatttactgtgctatttcagctgttttctgtagcctttccctgatctcctaaacttgagaggacagagagaactatctctgtaatacagatgagaggcacagga

SEQ ID NO: 63923 - DNA, 100 bp, Homo sapiens
aaattatattatggagaaataacaaaaatactaatataatgctgcacttgaaaacaaaaaggaataccttccatgggccagaagtagatatctaccaaaa

SEQ ID NO: 63924 - DNA, 862 bp, Homo sapiens
tgagacagagtctctctccgttgccaggctggagtgcagagaggctggacttctgtggtgacgggcagacaggactggtggtgttagtcctgatggtctcttaagaggaggtgggtaggccgggaacattggctcatgcctgtaatctcagcactttgggaggctgaggcaggcggatcgcctgaggtcaggagtttgagagcagcctggcaaacatggtgaaaccccgtctctactaataatacaaaaattagctgggcaaggtggtgggtgcctgtaatctcagctactcgggaggctgaggcaggataatcagttgaacctgggaggcggaggttgcagtgagctgagattgcaccatttcactccagcctgggtgacaagagtaaaaatcatcttaaaaaaaagaggtggtgggtaatcagttctcacagtagcctccttctggggttggtcctccaggccatatgcagtgggaagggaggatgagtaaaatggtcatgtcatgtaagtaaaatggtcttgtgtaatcattaggtttttattgaaatatacattgttaataatgtttgtatttttgtttgaaagcttaggaaaagccaattgactgattatccttcaaagagggtgccaaataggagaaaaaaatacattttattgtgttttgtactatgagttcctagaaacgtagtttggatatgaaattttataaaccaattattatgtatagcttgctagttaaaagaagttaaattacttcaaaaagtggagacactttgtaatgcaaacaatcctttgctttgtttctaatattttgccttttgcatattaggttatcttaaatcatgagagagagagaagg

SEQ ID NO: 63925 - DNA, 309 bp, Homo sapiens
aattcattaaattggataacctgattagcctctattactgagctcatcaatcacaccaagggcagaaaactaatagatgtcagcatctggcttggactattactactctttatctacctcctgaaactctgaatcaacaaatctttgttagaatgatgcttagtcactatgctcatttccagctgctgtggaagaaaaaacgctacctttattttttgtaagttccacaaggaagatgcaagttggtatttcctcatttctgagatgcactaacagcatattgcacacaagatcctatgtgttaccaca

SEQ ID NO: 63926 - DNA, 456 bp, Homo sapiens
tgaacttctgacttcaagcaatcctcccatctcagcctcccaaagtgctgggattataggcgtaagccactgtggccagcttaatatctttctagacatcattttgagttattacttcaggaaatatccgctagaaaacttttccatttctggaaactcagtatttttatttgtgagattaagatcccaaaatacaactctaatatacaaaaactgagaccctgaaaaataaagaacagaaaagtcaaacaagaatctctgccttcacatgtttccagaagacagctggtacatgtaattagagtggaagtttatttaaaatatatctaggacaggcatagtggctcacgcctgtaatcccagcactgtgggaggccgaggtgggtagatcacttaaggtcaggagttcaagaccagcctggccaacacggcaaaaccctgtctctactaaaaaca

SEQ ID NO: 63927 - DNA, 459 bp, Homo sapiens
accagcagaaaatcaaggaaaaacttagaataagaacaaaagcagctgtaaagatccaggcctggtggcggggcaccctggtgcgcaggacactgctgcatgcagccctcagggcctggataattcagtgctggtggcggatgacgctgtcgagggtgctggagaagaaacggcaggcagctctgatcgcctacgcaaccagagagagggcagtgatcaagctccagtctttggtccgtatgtggcgtgtccgctggcgatactgccaggtgctcaatgccatctacatcatccagggccactggcaatgccacaactgccagacctgcgctctcctccagggccactgtgtggtcacagccactcacctgcagttccacattgagatcatcaactcctaagggctggcaagaagggcactgtgtctactgtccctattaaaggtctaacctggaaagg

SEQ ID NO: 63928 - DNA, 314 bp, Homo sapiens
ccaggtgattagaaagctgtattgctcacacaaagcctgtttgttggtctcttcacacggatgcatgtgatagatatacaaagcatttttatagtcacattttggtgctcaactaaggctccctgattacacctctgccatatggatagtaagtcacttaagcttgtagaggagtatatttaattctcctttttgattctataatttttaactatagaatctcagtttagcctataggttttctaccatgaaaggcatttctacccctactgtagggtaggaatgagtttcccaatcaaattattaaaagttag

SEQ ID NO: 63929 - DNA, 527 bp, Homo sapiens
taacacttagaaaaatatacccaaactatgtttttaacagataaacagtccttaaggccttcagcatagttgacaaggttcataattcacctttatttaagcaactgagagtcaaaatgggggaaggagatggaatgcggacctaaaagccaaagggcactgtgggtgtaacgctgatgagtgaccttcaaccccaaggaagaaatactgatttcagaccttcttgctctagaagtcaaaatactttccccctgacaagaggtaagataaggtagaaaatagaaacactggaagagagatctggactcctaaagctgtgatgccatagtgtagtgggggggggtgcgtgaggaagtcaggaatgccgcaatgttaaagggaaagggaagatggagcaaagtgagtcccagggccagcagggggccagccttgtttgacaggggcaggggagaaaaggccagacttcccatacacatgctagagggagggctagtgtgaagggtaataagtgaaggagtccacgggct

SEQ ID NO: 63930 - DNA, 463 bp, Homo sapiens
cccaaagtgctgggattacaggcgtgagccaccatgccccgcccttttttctcgtctttaataataagagactatcctaggtgacctctaaaattccttttagttctaatatcctattattcaagaattagccattgtcattgatcaacagatagaattttagcatctgccgtttacatttttttattagctaatattttttgtaccagaatactaaagaatatttattgtgaaagctatttcttattttataaaaaattttaggtggttaagtttatatgtacgctgtaccttaaatgagaattacagcatgtcgtttaacttccacgagactattttgttatatagaaaatgcaaataatagtatacttcatggttgttgagaaaagcaaattagatttgaaatagattatgacggaaattacaagttgctatttaaattttgattgtggggtaactagct

SEQ ID NO: 63931 - DNA, 91 bp, Homo sapiens
agtttgcctacctctgtcctagagcgaagcctgagccttgggcgcgcagcacaccacaagtatctgttactgtgttttgcagaagcttcag

SEQ ID NO: 63932 - DNA, 231 bp, Homo sapiens
aataaacaatgtgcaggtttttataactgatcggaagaaggttgaccctcagttatcacctttaaaaaatggtcttagttaggctttctccctttgttcttttccagaagaaacttggagtctgtcaaatttcacaaaataccctgttgagattttgcttggctttgataagggtgaattcacagattaattcggaaaagaatttacgtctttctaatcaaattgttcctt

SEQ ID NO: 63933 - DNA, 217 bp, Homo sapiens
ggttgcagtgagccgagatcgtgccattgcactccagccttggggacaagagccagacttcctctcaaaaaaagaaaagaaaagaaaagaaaactacaggccaacatttcatgaatgtagatgcaaaaatccccatcaaaatattagcaaatatccataatgcatacaaaattatacaccatgaccatgtgtgatttattccatgtatgcaaggcta

SEQ ID NO: 63934 - DNA, 735 bp, Homo sapiens
gatcaatttgcttgaaaaatgcaaaataatttttacatacattgaaggttttatcattttaatagaaattgttcaagcatattaaggaacaagagttagcatttgaataattgcccataataaaaaattcttatttgcttttgacatttctgaatttgctttccattttaagactatcagggttcttaatatatatttatggaggttacatggattagtgtgacccaagagaatgatggtagtcaacatttcaaagttaataaagaccgcttttgacaataggggcagggattatatttttcatatataaaagaaaaaaatctgtcatttagtaaggttgatctatttgtctaagattatgcagctttgaaattgcagagtcagaatttgaatacagaaattctaacatcaaaatgcaaggtccaggttacggttgaattattgatttataagtaacatttgctgataattactttgaacaacacagagtaaaaaatctttagagatccccttggagttgtcttactatagagcataatcttaaagcaatttagttcagcaaacatttattctgcaaacatatattcagactctagtgtttacaaggcaccttgagaggaaactgtgggaggatatttggacaaaccaaaataagggtccctattctttaaaggaacttgccaatcttattgttgactactctgattgtattgggcacaaagcgattgcctatat

SEQ ID NO: 63935 - DNA, 1251 bp, Homo sapiens
tgagacggagtctcacactgtcacctgggctggagtgcagtggtgcgatcttggctcgctgcagcctccacctcctgggttcaagcaattctcctgcctcagcctcccaagcagctgggattacaggcgctcccccaccacgcccagctaatttttgttgtatttttaggacagacggcgtttcactgttggccagactggtctcaaactcctgacctcgtgatccgcccgcctcggcctcccagagtgctgggattataggtgtgagccaccgaacctggcccaaaacagcatttttggaagctacattctgtgagatgttcacctgtttgccacctcttctcgtgaaaaccatagtgagtgccagtgtgaaaggaagattgcagcgtatatgtcaagtagaaacatgtttgaattttccatttgtctgtggggaagaaggtaataacagtaataacagactgaaggaccaaaggaaaatagggaagacgttgattatggacttggatcagattctagctacatgatttgaaaatgacactgcctctcctattttgccacaagcctgtcatttggagaactggcagatcatttatgttcagatttgattttctgttttagaatcccatggagtacatgtgaacataggaaaatcacactcagcagccaagctatccttttgcgataatgaaatcactttaaaacctataacttgatcttaggttggcaaatcttaaacttaacgatccttgaaatttcctgcctgctgtgactgtgatgcagttggattcaactggtttacactgctcttggatcggcaagaccaaaaaaggttggactgcactgtagcatgcttatgggttgaggcagtggcagaggcagaggacttggccgtcagccagccagcacaggcgtaagaaaatagcatgagaagtttcacgagcctgaaaccattgagacagtgattacaacctccatattaatcagatgagggtttgtaggtgacatagcattttacccaagtaattctgaacagactgtggcttatgataatacattttaactagcaagtgtgtggactataaaacaaatatctagagttatatatggatgtactatcatttggtgataaaagcatagaaaaagcataagttggagtatactgggtttttttgttgttgttaaattcttttccatcagaagtaagagctgttggcagcaactaataaaatgcaacctagtgacatgctc

SEQ ID NO: 63936 - DNA, 1144 bp, Homo sapiens
agaacacagaagccattagagtctaggcctgctagatgttcaacactagcaggctgggaagcttcttcttactaaagggtaacaacatacacatagagtgtagttacaatttgcctccttatccaagaacacagtatatcctcaaattagaaatatagtatgcatttttcattttttcttggacttttttctagcctgaaccactaaaaaggcttatgactgctaacagctcaggaggaatgagcctctaaagtgcaaaactgtctctgaatatcatttacccgtgacagaaaccaggactcactggagaaatagctgagtctagtatagactaagaaatcttcaagatgagtttggaatatcttatatcacaccctcacgttcctcattgttagaatgggaccaatttcatagggttgggctgagttaatatcccgaaattacttagaacaataaggagtaactcataaggaccataaaggtgagcatatttgcatttcataataaaagggtgacattccagaacaacatttagtacacttagctgtatatgtatcaaaatctagtgctgcaaatcttatagcagagctaggactctgtcttcttaactcagtagcctaccttccaggccctttttgcctgcccgattttactttttaaacttttttgttgtaaacgaagacacatacgcattaatctaggcctaaatagggttaggatcttgagtatcactgtctgacaccttctaccgtgtcccacttaaggtattcaggggcaataacatgcacggagctgacatctcctatggtgacaatgacttctagaatgtcttctgaagcatctgcttgaggcttgtttttgagttaacttttcttttttagtaagtagaaggaatacattctaaaataacaataaatagtataaaaatatataaaccagtaatgtggtcacttattactattcattattatgtactgtatataatctactgtacataaccatatttactactgttacatgactggcagtgcagcaggtttaaatgacagacatgtgagtaatgtgctttacaatgttacactggctatgtcattaggtgattggaattttttagcactattaaaatgttatgagagcactgtca

SEQ ID NO: 63937 - DNA, 473 bp, Homo sapiens
aagatttttcacatctttgccggtttatgcaatcattgtggcaaatttttgcagaagctggaccttttatttgctcctcataagtcagcctgcttattttgaagaggtctttggatttgcaataagtaaggtgggtctcttgtcagcagtcccacacatggttatgacaatcgttgtacctattggaggacaattggctgattatttaagaagcagacaaattttaaccacaactgctgtcagaaaaatcatgaactgtggaggtactgtggatttcatagatggcttaggcagcttttgtagaattagggtaaactgaactgcagagcatatattaagaagtgacatttagtcattggagtggatcttaaagacctctaagtctgtccctcagcagacacttgagtgttgtccatcacagtgctgccaagaggtcatccagctgggacctttccatacatccttccacattt

SEQ ID NO: 63938 - DNA, 771 bp, Homo sapiens
ttttttatgttcatacccatcctgaggttcccagctccaggaacctccagctctagtacccagctcagtgcttgtgatgggaactcaggaaatatttgccagttggttctcttcatagaaatgcaagaagcagtctgggcgtggtggctcacacctgtaatcccagcattttgggaggccaaagcaggcggatcagctgaggtcaggagttcaagaccagcctggccaacatgacaaaaccccgtctctactaaaaatacaaaattagctaggcatggtggcacatgcctgtaatcccagctactcgagaggctgaggcaggagaattgctcaaacccaggaggcagaggttgcagtgagccaagatcacgctgccattgcactccagcctgggcaacaagagcgaaactctgtctaaaaaaaaaagaaatgcaagagacagatgaagcccatgattctggcctggatagtggattaggtttcctgcgcgttccttggtcagatgataaatgttagtttttacttcagtgccctcttagtatttacctatgtaagttatgcacacagatgaagacatttgtaaaaaccaacccaccaatattctaatgaaacaacttatagttttgaaatgtcacagataatcaaaagcccatggaaaaccatgcatattgtagccaaatctgtagtacacaatttattttttttaatagagacaggatctcactatgttgcccaggctggtcttgaactcctgggctcaggcaatccact

SEQ ID NO: 63939 - DNA, 383 bp, Homo sapiens
cacccccaagccctggcccaggtctttcggataaagggggccactgcccagtgtgcacaggcccagaaggaagaaaagacaagaaaggcaaggtgctgactgccttgggggttgtttggtgtaaacaggcagccattcagagaggcttcaaatcggttcaggatttgaagggaaaaaaaacagcaggaaaggtgacttgactcctgtgtgcccctaacctttacttagagcccatcaagctctaagtagctgccctgaactgcccaggttgaaactcttctgcctcttctacccacagaagtagtgacaggaagggggaatgaggatagcagccctgggcttggcatcttgtcaccttgaggagttaatttgcatgacacccc

SEQ ID NO: 63940 - DNA, 214 bp, Homo sapiens
ccaaagaactgcaaagtcaatgtggaaaatgcaagctactttatggagggaaagcaggagttgtgaagtacaggtctcacacagatacctgcagtgctcccactggtggctcgtttttctgtttttaaaagagaaatcagaaatccatatttttatgtgaaatttcctgattgaaaaaacaactctgagaagacccccatgacattttggacca

SEQ ID NO: 63941 - DNA, 8377 bp, Homo sapiens
  misc_feature (3994)..(3994): n is a, c, g, or t
  misc_feature (4036)..(4036): n is a, c, g, or t
acacctgcgcgccggaataattcatgaagaaggggctggatccgtgggtcagagaacacaggaccagtttgccatcccaaggccgaaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaataatacaatggcaatactgacatccttcatgacgttttcccgacagacattcaggcagaaagtgctggtgcgttttctgtctgcaaagtagagggccatcgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctccgacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacacgttccgcagcaccctctgacaccagcattcatgtcgcctggcaaacctgagcatctcctggaggggtccacatggcaactggttagccccatgagactcggaccctctggctccttgctggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctctccaccgaagacaagcccagcctggtgcctttgtctgtaccccggacgcaggtgatcgagcacatcacgaagctcatcaccatcaacgaggccgtggtggacaccagtgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccgcagcagtcacgtgtttacctcccacccccggatgctgaagccgcagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagccgcgggnggccccgccagagagaagaaaatgcttcttggtgagacagcncctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcaacccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggaggggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggccacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggccctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggccccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccggccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccatccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggcagcactcctgtgtacagatgc

SEQ ID NO: 63942 - DNA, 425 bp, Homo sapiens
aacacatccgcacccacactgacgtccggccctatgtgtgcaagcactgtcactttgcttttaaaaccaaaggtaagagagagtcagctggggcactgcccctgcccgctgcagggagctcccctctgggagtcccagcacagagttcaggtgcccagacctctttgcagggggcctggagcagccccatttcctgggttcccacccagcttggtgcccagtggcagagcagctggctccagactggcctgtggctccccatggctgcccccagccatcctcctggaacacacacacagcccctgcacctgtggccacccggccctggcctgcccagcctggtgcggcactcttgctcaccgttcatggttttgcatcttctctcatctcccctcccttctgcatgtctcctgagccgtttatcc

SEQ ID NO: 63943 - DNA, 8553 bp, Homo sapiens
  misc_feature (3994)..(3994): n is a, c, g, or t
  misc_feature (4036)..(4036): n is a, c, g, or t
acacctgcgcgccggaataattcatgaagaaggggctggatccgtgggtcagagaacacaggaccagtttgccatcccaaggccgaaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaataatacaatggcaatactgacatccttcatgacgttttcccgacagacattcaggcagaaagtgctggtgcgttttctgtctgcaaagtagagggccatcgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctccgacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacacgttccgcagcaccctctgacaccagcattcatgtcgcctggcaaacctgagcatctcctggaggggtccacatggcaactggttagccccatgagactcggaccctctggctccttgctggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctctccaccgaagacaagcccagcctggtgcctttgtctgtaccccggacgcaggtgatcgagcacatcacgaagctcatcaccatcaacgaggccgtggtggacaccagtgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccgcagcagtcacgtgtttacctcccacccccggatgctgaagccgcagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagccgcgggnggccccgccagagagaagaaaatgcttcttggtgagacagcncctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcaacccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggccacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggccctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggccccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccggccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccatccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggcagcactcctgtgtacagatgc

SEQ ID NO: 63944 - DNA, 2655 bp, Homo sapiens
ctggaagcttttcagaaccacatttttcaccctgcctacctccgtgaaaaccatctgtccatctgtcatgctaagaactgcccaaaccattaagtactttgaactgaagggaagatgagacaggatcagcaggcaggagcaggagctgaatcacgccagctcgtggctgtgccttgactcctcgaccccactttctgctggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggccacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggccctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggccccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccggccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccatccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggcagcactcctgtgtacagatgc

SEQ ID NO: 63945 - DNA, 484 bp, Homo sapiens
  misc_feature (8)..(8): n is a, c, g, or t
  misc_feature (32)..(32): n is a, c, g, or t
  misc_feature (35)..(36): n is a, c, g, or t
  misc_feature (43)..(43): n is a, c, g, or t
cccgggcntcaggaattcggcacgagctcgtnatnncggcacngacgagatcattcaccatgatcaactgggattcttcctagaaatacaaaaagggttcaacctgtgcaaaacaataaatgtgctacaccatattaacagaatggaggacagaaaccatacaatcatttcagtagatgcagaaaaaacatttgaccaaaaaatattgttaactgtgctttcttttctgaacttaagaacttgcttttccaaaaccttcccagaatccctgtatgaatcaacaaaatttagttcttaacacatttctccttctttaaaatggtgacattagctgggcatgatggtgtgtgcctttaatcccagctacttgggaggctgaggcaggagaatcgcctgaacccgggaggcagaggttgcagtgagccgagatcacgccactacactccagtctgggtgacgagcaagacttcgtctcaaaaaaaaa

SEQ ID NO: 63946 - DNA, 958 bp, Homo sapiens
gcctcagctgtcactgcctatctggttaggttctgcactttccttctcggaaaggctccacccttcctgccagtttcatctctagtgccttcaaacctaccctttcttagtgtgtgtggcatgagccagctcagtgcctgcctagtggcagacacttaggctgtaagtatagtgtgggcacaggacccaggatcctatctaaggtgcacaaaaccagctgtctcctgaactcctggagagaaaaaggcacacacccacgttacttagtttctttttctgcccctccacaccatcagcctgggatataccctgggctcccaaactcagagggggtactaggtaggctcaagttagacctatgaagcacttctctgggaggcctggctggggaagctggtgagactggaggaggtgagtaacggaggctgccatatcggggggagtgggggattaacaagaagacctcttggtttgcaggttcatgactctagctcacaaatactccttaaaaaacacaagagcagccactgagaggccaggatgggagccaaggggcctgcacacacacacccagccgctgcgtcttcctgtgtccttagtgtggcttggcagagcctggccagagcccatcctctcccttatacctgggcagaggccaggggctgtgaaggtggcagcacctgcaggtctggtgcctgtgagccccaggtccggtggagcaaggagagaggaggatgctggatgatgagagtgggaaccctagcagcaaggatgagcacagaagggggtgctggccaacgcagccaggatttgacctaaggatggggatccctggccccctgctcttgcccagagctggtgggggcctcagtgggccccagaaccaagaagagaaaggcaaggccagtggggccagacatctgtgtgttgacaataaagttttgtgttggaatcaatg

SEQ ID NO: 63947 - DNA, 236 bp, Homo sapiens
ggatccgcccttctaatttccagaatctaggactagttttgtcttgaggcaggaaatatataggtagcactggttttcttaccagtgacctcatatcaaagccccgatgaagatcaagcatccgtgagaatgacatggcaggcagggtgagggctcctcacttaattgatccttaacccagcaactaagtgctttcaggatatggatcagaagaaagatctaagtcagtggacatg

SEQ ID NO: 63948 - DNA, 4264 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 63949 - DNA, 2911 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcataggtatgtgaggtctccccatcttactcctcactcatgccccttgcctttctaacaactgttatcatgtcatcattgtt

SEQ ID NO: 63950 - DNA, 2839 bp, Homo sapiens
atagggtgtgagatgggtcagagcaaaggctatagttagggagctggaagccagaccaaggaaggtcctcttagccatgctaggtacctgggctctatcatggtaaatgaggggccattgaaggtcttacgcagagaagctccttgctcagatccctgttcttgaaggatcactcaggcagccagaggccaatatccatggagcaagctcctgctctgccagctgagtgatctcacatttcctcatataaacccagaccatcagtcttgagtgtggaaggccctattgccatcattttacagatgagaaaactggggcttagagaggatgtacttacccaagtgcaacagatgtacttacccaagctaagctgtgacagatagagattgtcaaaccagatttgtcttcaggtcttctttttacctcagcatacatagctgtctgtcattactacctcccagctctgggtgactcggatttcccctcatccaggaataagaaaggggtgctgggtttaggggaccaggtcagagatcttaaggagtctgtgaaaagctgaaaagcagtagtaaggataaagccaccatctccttgccctcttctgctgcctctgaacaggaagtcttggccaaaaaggttctcacttctccctgtttctcctggcctcaccccctccctccactgccccaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttg

SEQ ID NO: 63951 - DNA, 3609 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 63952 - DNA, 2556 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggtgagtagcttgagagataaccaaagaactacagaaaagctgtgggggcaagcgcctctccacccattccgccctccctca

SEQ ID NO: 63953 - DNA, 1826 bp, Homo sapiens
ccaaaccattgctgtctccccttttgcctctccctaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 63954 - DNA, 602 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctggtgaggcctgggaggggagcttcagggtggggcaaacctgggtggagacatctgagctgaatgttcaagggaacatctgagaggtcagtgggatacctgtgagcagaggcctgggctggaaggcttgggagggcaagctggggcggggctggccctaaatgg

SEQ ID NO: 63955 - DNA, 3736 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagcctcagagttcacggacatgggcaggactggaggaggggtggggcccaaggggggagtcttgctgtgcccacctcggccctgcctcacccccacccccagcgagggctccttagccaatggttggggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttg

SEQ ID NO: 63956 - DNA, 3319 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccagcctccggtggcaccacaggctccctcctccatcctgctgccagcagcccccatccccatccttagcccctgcagtccccctagcccccaggcctcttccctctctggccccagcccagcttccagtcgcctgtccagctcctcactgtcatccctgggggaggatcaagacagcgtgctgacccctgaggaggtagccctgtgcttggaactcagtgagggtgaggagactcccaggaacagcgtctctcccatgccaagggctccttcaccccccaccacctatgggtacatcagcgtcccaacagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 63957 - DNA, 2342 bp, Homo sapiens
acaaagtgctcgggacaaggacatagggctgagagtagccatgggctctggaggagacagcctcctggggggcaggggttccctgcctctgctgctcctgctcatcatgggaggcatggctcaggactccccgccccagatcctagtccacccccaggaccagctgttccagggccctggccctgccaggatgagctgccaagcctcaggccagccacctcccaccatccgctggttgctgaatgggcagcccctgagcatggtgcccccagacccacaccacctcctgcctgatgggacccttctgctgctacagccccctgcccggggacatgcccacgatggccaggccctgtccacagacctgggtgtctacacatgtgaggccagcaaccggcttggcacggcagtcagcagaggcgctcggctgtctgtggctgtcctccgggaggatttccagatccagcctcgggacatggtggctgtggtgggtgagcagtttactctggaatgtgggccgccctggggccacccagagcccacagtctcatggtggaaagatgggaaacccctggccctccagcccggaaggcacacagtgtccggggggtccctgctgatggcaagagcagagaagagtgacgaagggacctacatgtgtgtggccaccaacagcgcaggacatagggagagccgcgcagcccgggtttccatccaggagccccaggactacacggagcctgtggagcttctggctgtgcgaattcagctggaaaatgtgacactgctgaacccggatcctgcagagggccccaagcctagaccggcggtgtggctcagctggaaggtcagtggccctgctgcgcctgcccaatcttacacggccttgttcaggacccagactgccccgggaggccagggagctccgtgggcagaggagctgctggccggctggcagagcgcagagcttggaggcctccactggggccaagactacgagttcaaagtgagaccatcctctggccgggctcgaggccctgacagcaacgtgctgctcctgaggctgccggaaaaagtgcccagtgccccacctcaggaagtgactctaaagcctggcaatggcactgtctttgtgagctgggtcccaccacctgctgaaaaccacaatggcatcatccgtggctaccaggtctggagcctgggcaacacatcactgccaccagccaactggactgtagttggtgagcagacccagctggaaatcgccacccatatgccaggctcctactgcgtgcaagtggctgcagtcactggtgctggagctggggagcccagtagacctgtctgcctccttttagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtctgtacagatataccagtgaggatgccatcctaaaacacaggatggatcacagtgactcccagtggttggcagacacttggcgttccacctctggctctcgggacctgagcagcagcagcagcctcagcagtcggctgggggcggatgcccgggacccactagactgtcgtcgctccttgctctcctgggactcccgaagccccggcgtgcccctgcttccagacaccagcactttttatggctccctcatcgctgagctgccctccagtaccccagccaggccaagtccccaggtcccagctgtcaggcgcctcccaccccagctggcccagctctccagcccctgttccagctcagacagcctctgcagccgcaggggactctcttctccccgcttgtctctggcccctgcagaggcttggaaggccaaaaagaagcaggagctgcagcatgccaacagttccccactgctccggggcagccactccttggagctccgggcctgtgagttaggaaatagaggttccaagaacctttcccaaagcccaggagctgtgccccaagctctggttgcctggcgggccctgggaccgaaactcctcagctcctcaaatgagctggttactcgtcatctccctccagcacccctctttcctcatgaaactcccccaactcagagtcaacagacccatgctgaaggaagggaggtatgagaccgtaggtcaaaagcaccatcctcgtactgttgtcactatgagcttaagaaatttgataccataaaatggtaaagacttg

SEQ ID NO: 63958 - DNA, 1702 bp, Homo sapiens
acaaagtgctcgggacaaggacatagggctgagagtagccatgggctctggaggagacagcctcctggggggcaggggttccctgcctctgctgctcctgctcatcatgggctcagcctctgaggacaatgccgccagcgccagagccagccttgtcagctcctccgatggctccttcctcgctgatgctcactttgcccgggccctggcagtggctgtggatagctttggtttcggtctagagcccagggaggcagactgcgtcttcatagatgcctcatcacctccctccccacgggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctggcaacttatattaaatccacctcctcaagataagccttagggatatttatggctgagggaagtgggatggtctaaggcatggggaagggtgattggctgtggggaaaatgaagtaataggttcattctgcccaagtgtacttggggttcatggcatttcataaggacatttgtgtagaaaattgttttgctggctgggcacggtggctcacgcctgtaatcccagcactttgggaggcggaggtaggcagatcatgaggtcaggagatcgagaccatcctggctaacatggtgaaaccccgtctctact

SEQ ID NO: 63959 - DNA, 2467 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63960 - DNA, 2461 bp, Homo sapiens
ttcggctgcggctgcgtgtaatcggacgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63961 - DNA, 2414 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63962 - DNA, 2413 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcaattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63963 - DNA, 2442 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaacatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63964 - DNA, 2332 bp, Homo sapiens
ttcggctgcggctgcgtgtaatcggacgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaagtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63965 - DNA, 2473 bp, Homo sapiens
ttcggctgcggctgcgtgtaatcggacgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattaaaataccagagcagagtgttcttcttctgcatgcctgcgcccacaatcccacgggagtggacccgcgtccggaacagtggaaggaaatagcaacagtggtgaagggaactctgataaaacctgtccactggccccaggatgtctgctgttgatgcctatattcgccctgaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63966 - DNA, 2441 bp, Homo sapiens
  misc_feature (2417)..(2417): n is a, c, g, or t
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccaaagcctacattccctgctaacacagtctacagcgttcaacaacntagtacaacaaatagtcagcgcag

SEQ ID NO: 63967 - DNA, 1496 bp, Homo sapiens
ttcggctgcggctgcgtgtaatcggacgagggttccctgtgtgtgtgtccgctcgccctctgctccgtcctgcggctgcccactgccctcctacggtccaccatggccccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63968 - DNA, 2336 bp, Homo sapiens
  misc_feature (2290)..(2290): n is a, c, g, or t
  misc_feature (2295)..(2296): n is a, c, g, or t
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccccgctcanctatnngacacacatcccctttttttggataaaatttggaaaatgg

SEQ ID NO: 63969 - DNA, 2181 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcaccctgctggaggagaggctaggtgcctgctcctgtgaggacaacagcctggcctcggcgtcat

SEQ ID NO: 63970 - DNA, 1253 bp, Homo sapiens
gagcggccgcccgggcaggtacgcgggtggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63971 - DNA, 1435 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagtgaaggtgaggacgatgaactcactggcgacagttctgtgtttagtaaccagctttggaggcttaatttggcaatgtctcaacagagagtcttaacctcgaacctgcgtgaaatgtccacacaggtggataagctgccagaaaagggctccccatttgcgtgattagcagttctgggattgatgacgcatgagtatttgaaagtaattttttttggctgggcgcggtggctcacgcctgtaatcccagcactttgggaggtcgaggcaggtggatcacctgaggtcagttcgagaccagcctggccaacatggtgaaaccccgtctctactaaaactacaaaattagctgggcgtagtggcccatgcctgtaatcctagctacttgggaggctgaggcaggagaatcacttgaacccaggaggtggagattgtggtgagccgagattgtgccactgcactccagcctgggcaacaagagcaaaactctgtctctaaaaaagaaaagactttacctctaaaacttaacttataaaactttaaacattaatcatagtaattccaagtaaggagaagaaattcatggatgtattttctcttgtctagcatacgcccagtagcagggcc

SEQ ID NO: 63972 - DNA, 719 bp, Homo sapiens
aggccataaagaatgagcttctgaagtatgaaaggtcctggacaaagcagtggccctgggtctgggcctgtatagagagtgttgcacatcactgaccgtgggtatctctccttcagtttgtcactgtgcagaccatttctggaactggagccttaaggatcggagccagttttctggtgagtctggaagcttcttcaggaaagaattataaattccagatgacagggcttcctgttgtgtgtgtatttgactgttgatgcagaagtagatttcttctttccgtgaagtttgcagatgtcctattctcatgaaaaaatgaaaggactttgaagaaattacaggaaagatatattagtgatgatgataaattcagttcactaggaacttactatttactagggagcttttgcattttaacttgtttaatccctatgagagaggtacaattaaccccctttacaagtgaagaaagcaagacccagaaaggtccttggctacatggccagtataactgtcagagactattccaacccaggcagtcttactgctgagtcaatactgcttctcaaccatagagagaaactgggtttcagcagagaaaaatgttctctcaataaaacacatcaacatttttttgcctctcctttgttcatttttctgtttcctttcgtcccatcttttagcaaagattttttaagttcagccgagatgtctttctg

SEQ ID NO: 63973 - DNA, 801 bp, Homo sapiens
cccgggggtgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagccggggggggaatgcccggggtacgaagggtccttggtcttggtggctaccggttgcctggagggc

SEQ ID NO: 63974 - DNA, 2991 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaccttagggggggccccgaaacccaattggccgtccgggacccatttacaacttacggcccccgtttaaaaccatgggactggaaacccctggggtcccgaataaactggctggaccaaattatcttttctccagcctggttaacattgaaaaggcccgccccaatggcatttgcaaaatttggccaccttaatggcaaaagcgaaactgaaagggctaatgttatttaaaatcgccttaaaattttgacaaaccgctaattttttcccaaaggccgaatttcccaaatccgttaaaatggaaaaacctccgaaatagggtcatttctcgtcaagtgggaaacaggtgtcctttttaaaacacgtggcccacacgaaaagggcggacaaccgccttaaggccaaaaccccttccggggccttcccccatatctaggttaacgccaaatcgggactggggc

SEQ ID NO: 63975 - DNA, 2300 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacagctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63976 - DNA, 2403 bp, Homo sapiens
ttcggctgcggctgcgtgtaatcggacgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaagtggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63977 - DNA, 2359 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63978 - DNA, 2448 bp, Homo sapiens
  misc_feature (2397)..(2398): n is a, c, g, or t
  misc_feature (2406)..(2406): n is a, c, g, or t
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagactatnnaaccgggntcgtacaccatgagagcgccgcccgggcggcggcgcgcccgc

SEQ ID NO: 63979 - DNA, 1475 bp, Homo sapiens
caaccctcccctcaatggggcccggattggaatacatgggacggatcaagatcttcaactgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaacggcacgagctcgtgc

SEQ ID NO: 63980 - DNA, 2321 bp, Homo sapiens
  misc_feature (2251)..(2251): n is a, c, g, or t
  misc_feature (2274)..(2274): n is a, c, g, or t
  misc_feature (2285)..(2285): n is a, c, g, or t
  misc_feature (2295)..(2295): n is a, c, g, or t
  misc_feature (2297)..(2297): n is a, c, g, or t
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctcccaaactaccatcagngaatactacaaacacctctacgnaaataaactangaaatctagnanaaatggataaattcctctacacat

SEQ ID NO: 63981 - DNA, 1264 bp, Homo sapiens
agttagctagtacgagacgggtttgaatcggccgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtaagctacagcatccagcatgacacatgctctcatgctgggagagaatgccacgagggcatagagcttgtgggtgtgtgtgtgtgtgtgtgtgtgtgtgtgtccatccatgtccatgtccctccctaccctaagatgaaagaccagtatcgtagattttactgattttcttagccatatattcttcggtgtccttaagtttttccagcaaaggaaactgattactgcttctctaaacaaaaagtaacaaatccgtgagccaagaagatagatacaataaaaaatacctttgaatactctgag

SEQ ID NO: 63982 - DNA, 1143 bp, Homo sapiens
ttcggctgcggctgcgtgtaatcggacgagggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaccttagggggggccccgaaacccaattggccgtccgggacccatttacaacttacggcccccgtttaaaaccatgggactggaaacccctggggtcccgaataaactggctggaccaaattatcttttctccagcctggttaacattgaaaaggcccgccccaatggcatttgcaaaatttggccaccttaatggcaaaagcgaaactgaaagggctaatgttatttaaaatcgccttaaaattttgacaaaccgctaattttttcccaaaggccgaatttcccaaatccgttaaaatggaaaaacctccgaaatagggtcatttctcgtcaagtgggaaacaggtgtcctttttaaaacacgtggcccacacgaaaagggcggacaaccgccttaaggccaaaaccccttccggggccttcccccatatctaggttaacgccaaatcgggactggggc

SEQ ID NO: 63983 - DNA, 1957 bp, Homo sapiens
agcggagttggagggaggcagggaatctggcttgattggcgtgctgagacgcacctggcgcaaccctcccttctgaatcgaagttcaagtcccgcggacactgcaaccatgaaggagagacgggccccccagccagtcgtggccagatgtaagctcgttctggtcggggacgtgcagtgtgggaagaccgcgatgttgcaagtgttagcgaaggattgctatccagaggtgagctgcccgcccgcccgctggccggcttttctccctgcctgcccgccttggggtagatttccacctgctcaggagacgtggctcccccagccccagcccatcctcagccgctttctgaggctttaccatcctcagctgctttttggctggaggactgccctgccttagcttcccctgagacctgttccacttctgccgccccgctggctcctcctcacctcttcacccagaggccccatcagatcccctccaccttcctgcgtccctggagtctgctctcagacctatgtgcccaccgtgttcgaaaattacacagcctgtttggagacagaggaacagagggtggagcttagtctctgggatacctcaggatctccctactacgataatgtccgtccactctgctacagcgactcggatgcagtattactatgttttgacatcagccgtccagagacagtggacagcgcactcaagaagtggaggacagaaatcctagattattgtcccagcacccgcgttttgctcattggctgcaagacagacctgcgaacagacctgagtactctgatggagctgtcccaccagaagcaggcgcccatctcctatgagcagggttgtgcaatagcaaagcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtggaaattggaggggggagacaaccccctacttcctcccttggggtgcagaggcacggggagagggaggatgagacaatttaggacactggacatgagtttttcagatggccacggtgagggcttggaaggagacaggaatggggcgaggaaggagccaggcccggcatgaggacctgacgctgagagagaaccatcataccccaagccaggcactagattttggagggggcgactaccccagtgccccccccgctccagaggaaggaaagctgtgggggacggggggcatgctggcctcatgggcttgggggcctacagcagcctcaccttcagcttcatgcctcttccacacagcgtttccatgcaggtcaggggatgggaggggtccctgagcccttcccttcccctctaaggaggcagcaacggagagtggggaagtggagcggcagctcccttgggggcttagcccaggtgcttcgtaactgcaatcggaagtgcaggagctggtcagagccaatgagaaggaaacctcatctttgcatagcccatgcctcatggagaggtgacatcatacattcacatgcttctcacctaagtccccagggtccaagggagaagccccagacccccttctcttgcagagtgtgggggtggtggtgctgcaggggcagggctgggtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaatttggctccgtatt

SEQ ID NO: 63984 - DNA, 1127 bp, Homo sapiens
aggcactgaacgaggagaaggtggcctatgaccgcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtggaaattggaggggggagacaaccccctacttcctcccttggggtgcagaggcacggggagagggaggatgagacaatttaggacactggacatgagtttttcagatggccacggtgagggcttggaaggagacaggaatggggcgaggaaggagccaggcccggcatgaggacctgacgctgagagagaaccatcataccccaagccaggcactagattttggagggggcgactaccccagtgccccccccgctccagaggaaggaaagctgtgggggacggggggcatgctggcctcatgggcttgggggcctacagcagcctcaccttcagcttcatgcctcttccacacagcgtttccatgcaggtcaggggatgggaggggtccctgagcccttcccttcccctctaaggaggcagcaacggagagtggggaagtggagcggcagctcccttgggggcttagcccaggtgcttcgtaactgcaatcggaagtgcaggagctggtcagagccaatgagaaggaaacctcatctttgcatagcccatgcctcatggagaggtgacatcatacattcacatgcttctcacctaagtccccagggtccaagggagaagccccagacccccttctcttgcagagtgtgggggtggtggtgctgcaggggcagggctgggtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaatttggctccgtatt

SEQ ID NO: 63985 - DNA, 1672 bp, Homo sapiens
agcggagttggagggaggcagggaatctggcttgattggcgtgctgagacgcacctggcgcaaccctcccttctgaatcgaagttcaagtcccgcggacactgcaaccatgaaggagagacgggccccccagccagtcgtggccagatgtaagctcgttctggtcggggacgtgcagtgtgggaagaccgcgatgttgcaagtgttagcgaaggattgctatccagagacctatgtgcccaccgtgttcgaaaattacacagcctgtttggagacagaggaacagagggtggagcttagtctctgggatacctcaggatctccctactacgataatgtccgtccactctgctacagcgactcggatgcagtattactatgttttgacatcagccgtccagagacagtggacagcgcactcaagaagtggaggacagaaatcctagattattgtcccagcacccgcgttttgctcattggctgcaagacagacctgcgaacagacctgagtactctgatggagctgtcccaccagaagcaggcgcccatctcctatgagcagggttgtgcaatagcaaagcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtggaaattggaggggggagacaaccccctacttcctcccttggggtgcagaggcacggggagagggaggatgagacaatttaggacactggacatgagtttttcagatggccacggtgagggcttggaaggagacaggaatggggcgaggaaggagccaggcccggcatgaggacctgacgctgagagagaaccatcataccccaagccaggcactagattttggagggggcgactaccccagtgccccccccgctccagaggaaggaaagctgtgggggacggggggcatgctggcctcatgggcttgggggcctacagcagcctcaccttcagcttcatgcctcttccacacagcgtttccatgcaggtcaggggatgggaggggtccctgagcccttcccttcccctctaaggaggcagcaacggagagtggggaagtggagcggcagctcccttgggggcttagcccaggtgcttcgtaactgcaatcggaagtgcaggagctggtcagagccaatgagaaggaaacctcatctttgcatagcccatgcctcatggagaggtgacatcatacattcacatgcttctcacctaagtccccagggtccaagggagaagccccagacccccttctcttgcagagtgtgggggtggtggtgctgcaggggcagggctgggtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaatttggctccgtatt

SEQ ID NO: 63986 - DNA, 1460 bp, Homo sapiens
gatcctcagggattgaggatggtattcccagggctttagggcttaggcctattggggaaggaaaacaccatggctcaccatcagctctttctggcctacaccaggatctccctactacgataatgtccgtccactctgctacagcgactcggatgcagtattactatgttttgacatcagccgtccagagacagtggacagcgcactcaagaagtggaggacagaaatcctagattattgtcccagcacccgcgttttgctcattggctgcaagacagacctgcgaacagacctgagtactctgatggagctgtcccaccagaagcaggcgcccatctcctatgagcagggttgtgcaatagcaaagcagctgggtgcagaaatctacctggaaggctcagctttcacctcagaaaagagcatccacagcatctttcggacggcatccatgctgtgtctgaacaagcctagcccactgccccagaagagccctgtccgaagcctctccaaacgactgctccacctccccagtcgctctgaactcatctcttctaccttcaagaaggaaaaggccaaaagctgttccattatgtgaagtggaaattggaggggggagacaaccccctacttcctcccttggggtgcagaggcacggggagagggaggatgagacaatttaggacactggacatgagtttttcagatggccacggtgagggcttggaaggagacaggaatggggcgaggaaggagccaggcccggcatgaggacctgacgctgagagagaaccatcataccccaagccaggcactagattttggagggggcgactaccccagtgccccccccgctccagaggaaggaaagctgtgggggacggggggcatgctggcctcatgggcttgggggcctacagcagcctcaccttcagcttcatgcctcttccacacagcgtttccatgcaggtcaggggatgggaggggtccctgagcccttcccttcccctctaaggaggcagcaacggagagtggggaagtggagcggcagctcccttgggggcttagcccaggtgcttcgtaactgcaatcggaagtgcaggagctggtcagagccaatgagaaggaaacctcatctttgcatagcccatgcctcatggagaggtgacatcatacattcacatgcttctcacctaagtccccagggtccaagggagaagccccagacccccttctcttgcagagtgtgggggtggtggtgctgcaggggcagggctgggtgggggtcaccagactttttctgcccttagggtagtacagctggcatttgttttatagactcttgtctttggaattggggggagggggggagtgtttcaatctgttatatgttctgtgtttaatgaagaaaacctatttattaatgaaaaatataatacatataaagaatttggctccgtatt

SEQ ID NO: 63987 - DNA, 494 bp, Homo sapiens
tccccagtttatagctgactgtgcatcaaggcttatgccagctaagcttaaactttctccaggtccgaagattcataacaaatatttataattattattcatggtgtcaaaactgccctgtcagttggggacaggaagatcaggttagaggcagcctatgaggatagaaactcacatctgagtggtaggagaaaatgtatctgttcaggctgggtgccatggcttacacctgtaatcccagcaatttgggaggctgtggcaggcagatcacatgaagtcagaagtttgagaccagcctggccaacacggtgaaaccccatctctacaaaaaatacaaaaattagccaggcatggtgacacacgcctgtaatccctgctacttgggaggctgaggtaggagagttgcttgaaactgggaggtggaggttgcagtgagccgagatggtgccactgcagtccagcctgggtttcagagtgagactctgtctcaaaaa

SEQ ID NO: 63988 - DNA, 290 bp, Homo sapiens
attttcaaaaaacctttctatcctcacatggtagaagaggaaatggagccttagaaagttaaatatcccaaggtcaaaactcagccacccaatattctaaattcaatgttctatcaagacatgttgactatttattgcattatacaaagtcacaactttaaccaaataacattcacattttcagaagaccacaggactttgcctttctgcaaatctcttaagagtattactcatttaggtgtttttgagacagagtcttgctctgtcacccagggtggagtgcagtggca

SEQ ID NO: 63989 - DNA, 246 bp, Homo sapiens
cgttcaccttacaggcagaagattggacataccttctctgggaaacctgactagctcaagaggaaacatcttaagatattgacattgggagttccagccagatcaccctataaagaaactatattcaacaagacccatccatgttttgaagcctttaatcagttttttagtgcctcaaacatgtaaacataagcaaagaccatcagacatatgaggaaagcttctaatgtgagcaatagaaatact

SEQ ID NO: 63990 - DNA, 483 bp, Homo sapiens
cttatgacatgcctttatgtggtttttgtttatttatttatatttttaattttaatttttatttttgagacagggtctcactttgttgctgaggctgttgtgatcatagctcactgcaaccttggactcctgggctcaagcgaacctcctgcctcagcctcctgaatagctgggattacaggtgtgcaataaaaagtattcctggctaatttttactttttttttttttttttggtagagacaaggtcttgctatattgcccagctgatcttgaacttcttggccttgaacagtcctcctgccttagcctcccaaagtgctgggactgcaggcatgcactaccatgcctaattttcttttattttttatattcatataataaatacgatttatttatttatttattttgtttgagacagggtcttgctctgttgcccaggctggagtgtggtggcacgatcatagcttactgcagctttgact

SEQ ID NO: 63991 - DNA, 490 bp, Homo sapiens
tcaacataaattatttatgtttattcaagagtgtgttatgagaaaaatgatagctatagcaaatttttaatacaattttcatgtgtttttctcatcattgatatccaaacctgagtttttctctgaaatgattttcaagagactttaaaaataatgtgtgtatatatatagaaaaaaagaatgagcaaaatgggggggaatctgggttgaggtctgggagaagagtaaaaaaaatcagcgagattcttctcatagatttcagtttatctcaagaattttatacatgtaatttttataaaaggttagcatattacttcagagaaatatctaaaggcttacatcttgagctattagttgctgtattgtagggcttaagaacttatattagacaagtgtgtataaatcatatactactttaaatatatttcaagttcttaaaaaatattacctaaggtaggataatagttttcattaaaacactgatcattta

SEQ ID NO: 63992 - DNA, 461 bp, Homo sapiens
tgtaattcataaaatttccacaagctgtttattgaaattctgtttacacttgtcagaaataagcatttccttgtttaatgaaagatggctagcttcagttaagaccacacctgacaggccgggcatactggctcacatctgtaatcccaaaatgaaaaatggaaaaaaagtaaaaaagaaaaaaagaggccaggcatggcggctcacacctgtaatccctgggaggccaaaatgggaggatcacttgagtccaggagttgaagaccagcctaggcaacatagtgagaccccatctctacaaaaaaaaaagcattagcctggtgtgatagcacacacctgtagtcccacttaggtgggatactgaagcatgagaactgcctgagcctgggaggtcaaggctaaagtgagctgtgattgcaccactgcactccagcctgggcaagaaagcaagatcctgcctc

SEQ ID NO: 63993 - DNA, 476 bp, Homo sapiens
agccttgccagctgaggcagatgcacctgagtgtgagggcggcaattgacctgttcctccatgtgccctgttcctaccacctgaagggtaaccttcattaagttccctaccctgttccctacccacgtgaagggtagcttcattaagagaaagtgcagtcgaggtagatagaaacagcctctcagaaatggctctcatgcggattcggcttgctgctcgtattgtgggcgagccttggagactgagggaaggtgagtacttgtgagttcctaggcagagtgagtaccctgcgttgaatgtagaattttcctattaagagcagaacaaaacaggtttttagattagcactctgacgtgggctggaaatgcccggcaaatatttaccctagatgtaaaacactcacaaagtcaaatgttgtttggaaaaccctaaaatagaaaatttttactcagggttttatatttggtaattgtaa

SEQ ID NO: 63994 - DNA, 753 bp, Homo sapiens
ggtggggtgcacctgctgacggtcctcggctgcaaggcaggctcagttcaggctcccgcaggagctgcctttggtagtacaagttgacatggaaagagaacaatgttctcactgacataggggattaaaccccaactcctggctcttaacgtaagttttttcttccttttgacttgtgctcctctctctttccccctccaggtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 63995 - DNA, 586 bp, Homo sapiens
  misc_feature (1)..(1): n is a, c, g, or t
nattcggcatgaggcccgggcctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 63996 - DNA, 1969 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 63997 - DNA, 580 bp, Homo sapiens
atccttaattaaattaatctccccccccgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 63998 - DNA, 474 bp, Homo sapiens
ccctttccctgagacccccaggagaggcctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 63999 - DNA, 380 bp, Homo sapiens
aaaaaaaaaaaaaaaaaaaaaaaaaaaaaaaaaaaaaaaaaaaaaaaaaaaaaaaaaaaaaaaaaaaaaaaaaacacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64000 - DNA, 302 bp, Homo sapiens
acaaccacaataccttctaaggttcaggaaacgatgccgccgtgatatacccatgagcccgaatcgggcactgagtggagctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64001 - DNA, 1536 bp, Homo sapiens
ccaccgggcgttttgacctcaggccggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64002 - DNA, 1825 bp, Homo sapiens
aaagggaaactttcacaagtgtccggagccctgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgcgtgatgtcagtgttatatcctccaggaatactggccagagggctgtgctgaagttgctgctgccactggagccactccaattggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64003 - DNA, 2882 bp, Homo sapiens
  misc_feature (2061)..(2061): n is a, c, g, or t
  misc_feature (2065)..(2065): n is a, c, g, or t
  misc_feature (2067)..(2067): n is a, c, g, or t
  misc_feature (2080)..(2080): n is a, c, g, or t
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaaaaaaaaaaaaaaaaaaagaaaaaaaaacaacaacaaaacaaaacacaaaacaaaaacaacacaacaaaaacaaaacaaacacacaccaacnaaananacaacaaacaaanaacagcggggcgcccccgccccaaacaacctcccacaccggagggcgacccaccagcgagccgcccgccccacccagttcacgttcgacaacaaaagcgggcgcgccccacaaggagggcggcgtcaatatacacgaccaacaagcgagcggagcggcgcgatacaaaccacaaacagcgcgaggacgggaaaaaacaccgcgcgcaggcctgagggccctcttagtggacagaacgaggcgacctcacttatgtcgtcggggggggcggcagcacccatctggtgtggaggagaccaacaccacgcaccaagaaagacatcacaaaccgcgtcgcccaggcgacgaaaatctaaaacccaccacacggccggcgcggctacacgccccgcggtggcgcatcaaacaccaccccaactaatccttcctccctgcctctccatcaacatcacacccaacttcaccccccacactatcatttttcttttacataacccaatctcctacccaccaacactcttcttactgctaaacaatcacaccacaaccacctcccctgatctagctaacaactcactctcccctttcagagaaacagtagaaacagaccgcgacgggggcatggcgcgtggggaccggcaggctggtgggtgctggcgagagcttgagcgtgcaggtagccgcaagaggaggtgcccgcccggcagcgcaccagcacccgcaaagaggagtagctcacaacatagcaggggaggagtcgagtgggttgggatccacggagcgcaggcgagcaagcgccgaac

SEQ ID NO: 64004 - DNA, 2147 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaaaaaacaaaaaaaaaatgaacggttgcaaacgttgccacaatcagaaacccacccatcctgatgcctctcttggcttccccttgagaaggatgcctgaggcgggatgtccccccaaactccaggggacaactggggaagacatggggtatgcagagatatgatgccacgggacagggg

SEQ ID NO: 64005 - DNA, 2018 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctccctaccttttccttctttaatctcctggtttaccattgatgacttcgcctctgcatctactgacttgatttttcattctggcactccatcttcaaagcccctcacctttcccatccta

SEQ ID NO: 64006 - DNA, 2791 bp, Homo sapiens
  misc_feature (1970)..(1970): n is a, c, g, or t
  misc_feature (1974)..(1974): n is a, c, g, or t
  misc_feature (1976)..(1976): n is a, c, g, or t
  misc_feature (1989)..(1989): n is a, c, g, or t
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaaaaaaaaaaaaaaaaaaaagaaaaaaaaacaacaacaaaacaaaacacaaaacaaaaacaacacaacaaaaacaaaacaaacacacaccaacnaaananacaacaaacaaanaacagcggggcgcccccgccccaaacaacctcccacaccggagggcgacccaccagcgagccgcccgccccacccagttcacgttcgacaacaaaagcgggcgcgccccacaaggagggcggcgtcaatatacacgaccaacaagcgagcggagcggcgcgatacaaaccacaaacagcgcgaggacgggaaaaaacaccgcgcgcaggcctgagggccctcttagtggacagaacgaggcgacctcacttatgtcgtcggggggggcggcagcacccatctggtgtggaggagaccaacaccacgcaccaagaaagacatcacaaaccgcgtcgcccaggcgacgaaaatctaaaacccaccacacggccggcgcggctacacgccccgcggtggcgcatcaaacaccaccccaactaatccttcctccctgcctctccatcaacatcacacccaacttcaccccccacactatcatttttcttttacataacccaatctcctacccaccaacactcttcttactgctaaacaatcacaccacaaccacctcccctgatctagctaacaactcactctcccctttcagagaaacagtagaaacagaccgcgacgggggcatggcgcgtggggaccggcaggctggtgggtgctggcgagagcttgagcgtgcaggtagccgcaagaggaggtgcccgcccggcagcgcaccagcacccgcaaagaggagtagctcacaacatagcaggggaggagtcgagtgggttgggatccacggagcgcaggcgagcaagcgccgaac

SEQ ID NO: 64007 - DNA, 1885 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64008 - DNA, 1825 bp, Homo sapiens
  misc_feature (1683)..(1683): n is a, c, g, or t
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaacccccttcacttctctatctgcatgntgaggtcatgcttgggggggcccggttggggcccatcctgtaccgtttttgcccctttccacccctggggcccttggtgggggagttcccctgcaaaatcactctcttttgggccgggggggaacccacttgggggtcctct

SEQ ID NO: 64009 - DNA, 1855 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64010 - DNA, 1776 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctctcctgcccacacacatcaaaagaatcttccctacacccttctctgcctttattttttgatttgtgcaacttgtaactaggtgtttatggaataaaggagaatggaaaaaaga

SEQ ID NO: 64011 - DNA, 1578 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctcgtcatgagaggtgggttctcctgtgccggctctgccaccccacagcacgctcctct

SEQ ID NO: 64012 - DNA, 1510 bp, Homo sapiens
  misc_feature (14)..(14): n is a, c, g, or t
  misc_feature (17)..(17): n is a, c, g, or t
  misc_feature (24)..(25): n is a, c, g, or t
ttcaggtggtacgnccngcggtanntggatatcgtcgaccaggccgtcgggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64013 - DNA, 2001 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcggggtgagttggggagccctcctgtcccagagaagatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64014 - DNA, 1101 bp, Homo sapiens
gaattccggtgttcatgactttttggttatattacatattgatatatgaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64015 - DNA, 1536 bp, Homo sapiens
caaggagaccaggctgagcagtcgggtggtttcatggacatgtttgggatgatgaatgacatgattggaaacatggtgagacttgccccatacccttccccggccttgctctcagtgatggctgacaacaccttgcatcctctaaggcaagagggaaacagtatgctagtgaagggtaaagtactggataaagtaattgaaccagagagccttgggaccctgtacctgctgtcatgcctgcctgaagcagccggcagcagctctcttacgtagcatacaattaaggccctgtctcttcaggtccttcttgctcgtggttggactcagaggaatttgggagggtaatgatgaggcctgatgttttttcagttcttgcattttgtgagaaagatacaggctagaacaggcagctgaagggtgaaatcccttcaccaggggtgatgcctccccattcagccctcccctacctaccctgtcctcaggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64016 - DNA, 1012 bp, Homo sapiens
acgccaactctcttcacaatacatcgtgtgtagagctatacgaagtataacatgagacattcataatgctcaccgtgtcccgcgctcttcggccgacacgagttgacggtgcgccattcaaatcgagctgtggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64017 - DNA, 600 bp, Homo sapiens
tcgagaggaaaaagttattcaggggatgatttctcagcctctcagcctgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64018 - DNA, 1008 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgcctttattttttgatttgtgcaacttgtaactaggtgtttatggaataaaggagaatggaaaaaaga

SEQ ID NO: 64019 - DNA, 917 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64020 - DNA, 1508 bp, Homo sapiens
aacttacgctaggtagcgaggctgggtgttgcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64021 - DNA, 2376 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggtgagacttgccccatacccttccccggccttgctctcagtgatggctgacaacaccttgcatcctctaaggcaagagggaaacagtatgctagtgaagggtaaagtactggataaagtaattgaaccagagagccttgggaccctgtacctgctgtcatgcctgcctgaagcagccggcagcagctctcttacgtagcatacaattaaggccctgtctcttcaggtccttcttgctcgtggttggactcagaggaatttgggagggtaatgatgaggcctgatgttttttcagttcttgcattttgtgagaaagatacaggctagaacaggcagctgaagggtgaaatcccttcaccaggggtgatgcctccccattcagccctcccctacctaccctgtcctcaggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64022 - DNA, 1907 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcggtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64023 - DNA, 1624 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggaacacatgacagctggaggcaattgccagaccttctcatcttccactgtcatctcctactccaatacgggtgatggtgcccccaaggtctaccaagagacatcagagatgcgctcggcaccaggcgggatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64024 - DNA, 1430 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagcatcacagatggcaacatgccagggaccaggcctgccagccgccggatgcagcaggctggagctgtctccccctttgggatgctgggaatgtcgggtggtttcatggacatgtttgggatgatgaatgacatgattggaaacatggtgagacttgccccatacccttccccggccttgctctcagtgatggctgacaacaccttgcatcctctaaggcaagagggaaacagtatgctagtgaagggtaaagtactggataaagtaattgaaccagagagccttgggaccctgtacctgctgtcatgcctgcctgaagcagccggcagcagctctcttacgtagcatacaattaaggccctgtctcttcaggtccttcttgctcgtggttggactcagaggaatttgggagggtaatgatgaggcctgatgttttttcactcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64025 - DNA, 992 bp, Homo sapiens
aaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactgtgtggagccccctggagctgagatcaggatgttccgcttcatgagggacgtggagcctgaggatcccatgttcctgatggatccctttgctattcaccgtcagcatatgagccgtatgttgtcaggtggctttggatatagccccttcctcagctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaaga

SEQ ID NO: 64026 - DNA, 850 bp, Homo sapiens
cggccgagagctccaccgctgaggccaacgaggccacgctttatttttattgtcccatctctccagtaagcatttaaaacacagaatttttagttaataagcaatgtggatttgtgttgcatccattgttttttcttgaattatatcatcagcttcatagtatgtttcatttgttgcatttgatgctgcatttgaattgagggctttggtttttccatttgacttgccttcttgagtggaagaagcctctaagtgttgaagcttaaggccagtgtctaatctttgaggtttcgtatacagaaataaatagcaaaggacacagacactgatgacaaaggcgagtaaaacaagggcagcaattcctagtccaatcaaggcaccaatgctgtatttggaacatacgtcattgaaaagtaatgatctttttcttcattatcttcctggcttgcctttaggcttctgctctttctctgggattaggacactgacaagtttgacctgaggctccacatgtagctgtgcttgtaggggaagtagctgcccggctcgctgcagcagtacttgaggtcggcgaagccgcagcaatactggagcgctgccccctcgccgcgccgggggcactggaagggctccacgaagctctggttgaggctgtagtagccggagcacagtcggctggcctcgctcatcgcgggcaggggccgggagaggctcgcgagggccccggtctgctctcggatcgcacccgtccagcacctccagagcccgcggacccctctgcccggactcggctcttccgatctgggctctggctgcctgggcgctcagccttcgcgcgccacctctgatt

SEQ ID NO: 64027 - DNA, 2587 bp, Homo sapiens
gcgaaggccagtcttctgatctcagtatctcctcccaactcctctaaaaataggtagagtggcagagaattggggtgcctcttctatagcacaacccatgatgcatccagtcatgcctgaccccactatgcctttcccacaaattgggaggagttggggcagtgagcattttgctagctctgtctgtttcttgcttcttgtgcccatttatagtccttggccatggagcaacaaaagtagaatggtgccagtgccttaactaaatttttctcaacctagattttcacctgagacaatatggtaatattattaaattactgtaaagatagcaaattttctgggatactttaaaatcaaagttgtatcaaagatcaagaagcacccataaaagctttataaactttcacaaaaaataagtgaaaattctttgtttttatggccgtgtaaaatgtcatttttataatggaaatgtcttaattttcaaacttaacatatactttaagcaattttagtatttaaacctttgcaaaattgtatttttgaatgtgaagttcaactttggcagtaggttgttgcaatagtgactctggcactatggtgccagtatagccacatagggttatttaaattaattaaataaatgaaaaattttattttttcagttgcattagccacatcttaagtgttcagtagccacatgtgactggtggctaccatattagtgcagatatagaaagaacatttccatcatcacagaaacttctcttaattctggtctagaagataaccttagtacttggtagaaattttgacaggctaatgacgaaaagtttgtaaccctgagctttgcatgcccaagaaaaataaggtattcttttttatatatcagaccagagaagctgtattcagcacattttgaaatgctagtttttggctatggccataccaccctaaatgtgccagatcttgtctgaaatgctagtttctgactacaaaaactacaggacatagtagatatgctcagtagagctgcttaaaataattccctttttttttctgttgaattctgttacaaaaccaggtctgtgttataatagaaaacacacttatgaataaaaatctttaaaaattataatttgcagaaattagttttatttctagatttctaggtggtattaatgtgatagcattaggtgggaccagagaactcatttgttttgtagctttcattatacagattatttaggaaatatatcagcaaaggattttttgttatgcttatctcttgaaacaaaatatttattgtacagattatacattgtgatttttttgttactgagtatattgtttgtgcccagaaaaatctaaaaagatgtgggttgacttctaagagatttaagaacaagtcacctctagtttttaagacagttcccttgatatttacctatccagtaccatctcataagaataactgcctgtaagtatcagaaagttgagaaatgctggtaatgtgacataaacttctcactgttcttcactgagataggactgcttatcttgttattgataaattatttaatttctcctgaataattagcataatctcatgtgatacagaaacatcttaattagcaaataaatttatacaaaggaaaaccaataaaaccttaatgtgcgtttaataaagtaactgaatgatcaaaaatgcagctgtgtcttgctttgtgagtgacgaatttttgaaaagcaatattacaaaccgtttcaagtgcacgctttatttttattgtcccatctctccagtaagcatttaaaacacagaatttttagttaataagcaatgtggatttgtgttgcatccattgttttttcttgaattatatcatcagcttcatagtatgtttcatttgttgcatttgatgctgcatttgaattgagggctttggtttttccatttgacttgccttcttgagtggaagaagcctctaagtgttgaagcttaaggccagtgtctaatctttgaggtttcgtatacagaaataaatagcaaaggacacagacactgatgacaaaggcgagtaaaacaagggcagcaattcctagtccaatcaaggcaccaatgctgtatttggaacatacgtcattgaaaagtaatgatctttttcttcattatcttcctggcttgcctttaggcttctgctctttctctgggattaggacactgacaagtttgacctgaggctccacatgtagctgtgcttgtaggggaagtagctgcccggctcgctgcagcagtacttgaggtcggcgaagccgcagcaatactggagcgctgccccctcgccgcgccgggggcactggaagggctccacgaagctctggttgaggctgtagtagccggagcacagtcggctggcctcgctcatcgcgggcaggggccgggagaggctcgcgagggccccggtctgctctcggatcgcacccgtccagcacctccagagcccgcggacccctctgcccggactcggctcttccgatctgggctctggctgcctgggcgctcagccttcgcgcgccacctctgatt

SEQ ID NO: 64028 - DNA, 353 bp, Homo sapiens
gaatggtaacagaagtatggccccgagggaaggaggcaggtccagggctacagtgctttcaggtactggtgtttctatacttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64029 - DNA, 897 bp, Homo sapiens
ggaaacaaggctcagggaattcagggaccggctggcatcacgtctgggtggtcagaatggatccacgcctgatggctccacgcatttcccttcgtgtgagtaaatctgtccataccgcaaccccatgcttggcattccaaggacactcctgtgctggtgacagagaggggagttctcaggctttaagcccaccagcttaatggcctttgcagcaagcttcaagtctgcacgtagagctcaggcttcaagttagggtgacaccaaggtctggacagtccatcatcatgctgttcagcagcctgtaggataggtggtggtattgtcataatttcagagagatgaaatgacaggtttgttggattccactccgcacaatcccctcagttgggaaggcagtaatctctgtcctgagcacattgacctcatcagggtcagcctcctcttctgcaaaacatgcgctcactaatcagggcattcattcagataatctctgggcccctatcacgtgataggggccacacgaggcccagagaacaaagacaacccgggccctgctcatggggagccagggatttattaggggagggcggcagtgcatggggcaagggtggtcagggaaggcttctcccaagaaagacacctaagccgagatcaaatgccacagggtgacaaagtgtaccaagcaaagggaatggattgagcaaggctaagagggaagaatacgggtgacatattagaataggtaagactgtgatgctggagcttgaacgtgagagcttgttggaccctgggagccattgaaagactaactcagcaaggctgtggtctgatctaatttgcctttataaatgcctacttcatggcaagtagataaaggggtccaagagttagggctag

SEQ ID NO: 64030 - DNA, 686 bp, Homo sapiens
tggcagatgagtcgttcgcgccgataacgaaggtatttttacccggcccgcctgtcagccggttaaaatccgagttcgccttgacataaagaatgtcatcgccctcgccgccctccagttcgttaccgacgtcattgccaattaaaatgtcattgtccgcacaatcccctcagttgggaaggcagtaatctctgtcctgagcacattgacctcatcagggtcagcctcctcttctgcaaaacatgcgctcactaatcagggcattcattcagataatctctgggcccctatcacgtgataggggccacacgaggcccagagaacaaagacaacccgggccctgctcatggggagccagggatttattaggggagggcggcagtgcatggggcaagggtggtcagggaaggcttctcccaagaaagacacctaagccgagatcaaatgccacagggtgacaaagtgtaccaagcaaagggaatggattgagcaaggctaagagggaagaatacgggtgacatattagaataggtaagactgtgatgctggagcttgaacgtgagagcttgttggaccctgggagccattgaaagactaactcagcaaggctgtggtctgatctaatttgcctttataaatgcctacttcatggcaagtagataaaggggtccaagagttagggctag

SEQ ID NO: 64031 - DNA, 2055 bp, Homo sapiens
cggtatggctatgtgaccacgcctcggaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgcaaaaaaaaaaaaaaaaaaaaaaaaaaaaaaaaaaaagggggg

SEQ ID NO: 64032 - DNA, 2242 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 64033 - DNA, 2033 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggaccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgcaaaaaaaagattttaggctgggcgtggatgcacaagcctttattccccgcactttggggtacc

SEQ ID NO: 64034 - DNA, 2309 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtgaggcttcctacgaacctccgtgggctggccgcccccgcccccaccctctcccgactgtaccattgggttccccactatcctgcaagaggctcatcagaacttaacattggttcacggccttactaccctgaacgcatctgacctcggaagctaagccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64035 - DNA, 1809 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccacccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64036 - DNA, 2091 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64037 - DNA, 677 bp, Homo sapiens
gaatggtaacagaagtatggccccgagggaaggaggcaggtccagggctacagtgctttcaggtactggtgtttctataggggcatttgccacccacatctttggaaactcgcctggcctattgtgacatggcagggctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64038 - DNA, 2147 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64039 - DNA, 2188 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgcaaaaaaaaaaaaaaaaaaaaaaaaaaaaaaaaaaaagggggg

SEQ ID NO: 64040 - DNA, 2209 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgcaaaaaaaagattttaggctgggcgtggatgcacaagcctttattccccgcactttggggtacc

SEQ ID NO: 64041 - DNA, 2260 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggaccctcaccagacttcaccaaacaataccagtggtctctaacctgacctgggctgatgcctgctcagattcccaccccagccttctgcagctctggatgtgtttctgcctccgtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64042 - DNA, 1846 bp, Homo sapiens
gaatgagtctgcagggagaaggtgctgggcccagggtgggctgtgggagaccagcagagaggtctagattgttatgtgaccttactgagcctagctcagcccccaagaaggagcttgggagagccaatttcagcaactgttctgcccatggaataaccactctctcttctctctctccatcactttcagggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcatcttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgca

SEQ ID NO: 64043 - DNA, 1453 bp, Homo sapiens
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtgaggcttcctacgaacctccgtgggctggccgcccccgcccccaccctctcccgactgtaccattgggttccccactatcctgcaagaggctcatcagaacttaacattggttcacggccttactaccctgaacgcatctgacctcggaagctaagccaggtctgggtggtcagaatggatccacgcctgatggctccacgcatttcccttcgtgtgagtaaatctgtccataccgcaaccccatgcttggcattccaaggacactcctgtgctggtgacagagaggggagttctcaggctttaagcccaccagcttaatggcctttgcagcaagcttcaagtctgcacgtagagctcaggcttcaagttagggtgacaccaaggtctggacagtccatcatcatgctgttcagcagcctgtaggataggtggtggtattgtcataatttcagagagatgaaatgacaggtttgttggattccactccgcacaatcccctcagttgggaaggcagtaatctctgtcctgagcacattgacctcatcagggtcagcctcctcttctgcaaaacatgcgctcactaatcagggcattcattcagataatctctgggcccctatcacgtgataggggccacacgaggcccagagaacaaagacaacccgggccctgctcatggggagccagggatttattaggggagggcggcagtgcatggggcaagggtggtcagggaaggcttctcccaagaaagacacctaagccgagatcaaatgccacagggtgacaaagtgtaccaagcaaagggaatggattgagcaaggctaagagggaagaatacgggtgacatattagaataggtaagactgtgatgctggagcttgaacgtgagagcttgttggaccctgggagccattgaaagactaactcagcaaggctgtggtctgatctaatttgcctttataaatgcctacttcatggcaagtagataaaggggtccaagagttagggctag

SEQ ID NO: 64044 - DNA, 2528 bp, Homo sapiens
  misc_feature (12)..(12): n is a, c, g, or t
agcgggcggcgnaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64045 - DNA, 2173 bp, Homo sapiens
aaagagactaggtcttactttgttgcccaggctggagggtattggtacaatcacagctcactgcagcttcaaccttctgggctcaagcacaccttccacctcagcctcccaagtagctaggactacaggtgcatgccaccacgcctggctaattattttttatttttttgtagaggcagagtgttgctatgttgcccaggtcgatcttggactcctggccttagcaatcctcctgccttggcctcccaaagtgctgggattacaggcatgagccgctgttcccagattgaattaaatttttttttctttttttagagatggggtcttgctgtgtttcccaggctggtctcaaacttctggcctcaagggattctcccatctcaaccccccaaagtgctgggattagcggcgggagccagcacacctggccaacaactgaattaattttattttttccaacttctattataggttcaggggttacatgtgcaggtttgtaaattgcctgacatggggatttggtgtacagatcatttcatcacccagtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64046 - DNA, 2531 bp, Homo sapiens
  misc_feature (13)..(13): n is a, c, g, or t
ctagctagtgtanaccggttagagcagtattagtctactaggagctgtggattcgcgagagcatgagcagactcggacgaggagtcagcgcgcccttgtggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64047 - DNA, 2570 bp, Homo sapiens
  misc_feature (12)..(12): n is a, c, g, or t
  misc_feature (2502)..(2502): n is a, c, g, or t
  misc_feature (2506)..(2506): n is a, c, g, or t
  misc_feature (2514)..(2514): n is a, c, g, or t
  misc_feature (2518)..(2518): n is a, c, g, or t
  misc_feature (2521)..(2521): n is a, c, g, or t
agcgggcggcgnaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttggttatacccatncagnaaataatnccgnttngcggccagcccccccccccttccttgcggagatatctctgactcgatgt

SEQ ID NO: 64048 - DNA, 2350 bp, Homo sapiens
  misc_feature (12)..(12): n is a, c, g, or t
agcgggcggcgnaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64049 - DNA, 2447 bp, Homo sapiens
gtggtgacatgtgcctgtggtcccagctactcaggaggctgaggtgggaggattgcctgagcccaggaggcgaaggctgcagtaagtggtgattgcaccactgcactccaacctgagcgacagtgggaccctgtcttgaaaaaaaagaaaaatgtatgaaaagttctttacttagtgcctggttcataatcattctgtagttataattttaaaggtgattgtatttatgtgtatgtatttttgtttataaaaaataacaagtgttgttctgttccttttcaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaattatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64050 - DNA, 544 bp, Homo sapiens
gacgctacttcccctatcatagaagagcttatcacctttcatgatcacgccctcatatcattttccttatctgcttcctagtcctgtatgcccttttcctaacactcacaacaaaactaactaatactaacatctcagacgctcatgaaatagaaaccgtctgaactatcctgatatgccattcttgctgatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64051 - DNA, 521 bp, Homo sapiens
gctgacaaagcaagattttttgcgaaactacactccaagccttgcttgtacactgcattcctcaggaggttgtttattgtgttgttgattttctttcccttttgaatatgagatatcagagtaagaaaattctgatcagagttttctgaaaactcttatcagcaagaatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64052 - DNA, 1258 bp, Homo sapiens
  misc_feature (12)..(12): n is a, c, g, or t
agcgggcggcgnaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagcgtctgggatcctctccgtcca

SEQ ID NO: 64053 - DNA, 2998 bp, Homo sapiens
  misc_feature (12)..(12): n is a, c, g, or t
agcgggcggcgnaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctgaaaaaaaaaaaaaaaaaaaaaaaaaaaaaaaaaaaaaaaaaaaaaaaaaaacaaaaaaaaaaaaggaggggggcacccccaaaaattctcccccagggggaccacaaaactagagggcccaccgttttggagcaaaaacagggggacccacaaagaagcaaggccgctatttaaaaaacacgaaacgacaagcgcggcgcgcgcaataaataacaaacaaaggaccagcagtgagaaaaccggtgccaatcatgcggcaaagacactcgtagagacagaccaaacaaacaaaaggtggaagtagcgaccaaatatagtgaggcaaaaacccaagcaaacaagaactatagagcgccaagagaacaccaaaagaaccatcgaaaagcagtcaaccgaagcacccacaagacgaataaaatgacgtgtcaaacggaaccagctgtccaccgaacgcatacatgaaaacataaa

SEQ ID NO: 64054 - DNA, 2501 bp, Homo sapiens
gtggtgacatgtgcctgtggtcccagctactcaggaggctgaggtgggaggattgcctgagcccaggaggcgaaggctgcagtaagtggtgattgcaccactgcactccaacctgagcgacagtgggaccctgtcttgaaaaaaaagaaaaatgtatgaaaagttctttacttagtgcctggttcataatcattctgtagttataattttaaaggtgattgtatttatgtgtatgtatttttgtttataaaaaataacaagtgttgttctgttccttttcaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64055 - DNA, 2643 bp, Homo sapiens
  misc_feature (12)..(12): n is a, c, g, or t
agcgggcggcgnaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagagtctcaccctgtcacccaggctggagtgcaatggcatgatctcagctcactacaacctccgcctcccgtgttcaagcaattctacctcatccagccgagtagatgggattacagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctga

SEQ ID NO: 64056 - DNA, 2191 bp, Homo sapiens
  misc_feature (12)..(12): n is a, c, g, or t
  misc_feature (1997)..(1997): n is a, c, g, or t
  misc_feature (1999)..(1999): n is a, c, g, or t
  misc_feature (2006)..(2006): n is a, c, g, or t
  misc_feature (2061)..(2061): n is a, c, g, or t
  misc_feature (2106)..(2107): n is a, c, g, or t
  misc_feature (2110)..(2110): n is a, c, g, or t
  misc_feature (2115)..(2115): n is a, c, g, or t
  misc_feature (2125)..(2125): n is a, c, g, or t
  misc_feature (2131)..(2131): n is a, c, g, or t
  misc_feature (2137)..(2137): n is a, c, g, or t
  misc_feature (2146)..(2147): n is a, c, g, or t
  misc_feature (2154)..(2154): n is a, c, g, or t
  misc_feature (2156)..(2156): n is a, c, g, or t
agcgggcggcgnaggcgcactgggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttcagatctattaatgtagggnantttttcnctaagatgaattcctatatttacttggtaagatccactaatctgtatagggagtngttctcttgccttatagtgagctatttggttgacaaaagtcaacnnaantgatntgaaaactanattctntacttnttgtgcctnnatgttgntnctaaaaagctcaatgggttaccaaatgcaccggca

SEQ ID NO: 64057 - DNA, 197 bp, Homo sapiens
ggtccattgtacaagaagaggggtccaaacctactgatggattgtcattattgtgtgctagtggcatagaggtagacccaatagaactcctgccccaaacagggcaacagccaagctcagttcatccaagccccctgaacagaccttccagcatccccatggtgaagctgttgctgtctagagctacttagtgtcag

SEQ ID NO: 64058 - DNA, 827 bp, Homo sapiens
  misc_feature (91)..(91): n is a, c, g, or t
attcaggctgtgtcctgcctagtgctcctagcctggtaccagtcagatagatagttgaagtatctcacctcaggcaaagcaacattgatanattgatgcatgtagtgtctggaggttgcttggcattgcatttgatcaggaataaaaaggaagtttagggagtctgtctcagtaccctgtggctttcactgcaatcaaaatacgatcttgcacaggtcagagccgtgttcaagtttggcaagaaataaggctaattttttataggtataccgtactttccaaattgtgggttatgaaccattaatgcatcatgaaataaatgtagtgggtcacaatcagcattctttttaaaaatgagaagtatatgccatgtagtaacttacatgtaaattttgtttatacacagacaaaatgtgggtgtgtactgggtcctgacatgagacactgttcccattgtcgcggatcagggatagttctttgtggttttagttgttgagttctgtttctttgttattcctttcgtggcagcactacattgtagcgtgctcactaagtgtcagaggtttacctcacgccagttgtgttcatttggctgcaggtaactgaagacccaacctaaggcaaagcagacttctttatttttgtaagacttcattaagagcagtttcagattctcagcaaaattgagaggcatgtacagagatttcccatatatcccctggtcccacacatgcatagcctcctgttatcaacaccccccactagaatggtacgtgtgttgcattgacgaacctgcattgacacatcatgatcacccaaagtccata

SEQ ID NO: 64059 - DNA, 201 bp, Homo sapiens
attctataaaatttttctttagatattcctcacgtataaaacaagagaactagggtagatggccttttagctatgggagtaaattaatttaatgacttccttttagagtgtcctgaattaattgttcaataaatgtagttaactgactagaatattttgttggcagctagcaaagacaatcagtggccaggcatggcggct

SEQ ID NO: 64060 - DNA, 265 bp, Homo sapiens
tttcggacatttttaagtttacaactgaaatttttcatcttaagtttaaataattacaaaagataccgtttcagtgtattttaaatgttcacattttaaaataaaactgctaaatatttctattgtgcaatagtcagaaaatttccatctctttgctgttgaactataatgtatctttattttaatgtaatatatttttgttttaatgacttgtctgctacataaacatgtaaattgaaattaaattatttctgtcactaagaga

SEQ ID NO: 64061 - DNA, 409 bp, Homo sapiens
cagagctatcagcttcccagtttgcacaattcatcaagaaataatgcagggccgctggcacaaatgatgaggcatctcccggaagcttaacttcctatccatcccatctcttggacagacgatgccagttaattacgttgaattttatcttctaggagcagcttgactatctaatctgggtttaccacttctggaagactttttacccacagtgggactctgatatttgtgtaactggaaatggaaatgagatcttctgaatgtggaatgcaaaggagaggatggagtcactctgtcgcccaggctggattgcagcagcacaatctaggctcactgaaacctcagcctcctgggttcaagcaattctcctgcctcagtcaccctacatagtcatcattctgacatcatc

SEQ ID NO: 64062 - DNA, 6595 bp, Homo sapiens
  misc_feature (2398)..(2398): n is a, c, g, or t
tgcttgcactcattttctccactgccaccctgtgaagagttgccttccgccatgattgtaagtttcccgaggtctccccagccatgcagaactatgagtcaatcaaatcccctttctccacgaataaccccgtcttgggtatttcttcatagcagcataggaatggaccaacacacttcctgaatcagaaactcaggggatgaggcccatcaatctgtgtttcaacaagacttccagggactgcgatgtgcactcaagtctgagaactacaccagtaagtgataataaatatgacaacatatttttttgaatgctttaatgaaccttatctattttccttgcaatgccctgggcttcctccaaatgagtaaagaatttctgcaaagtcacttagggttcagcagaatcccaggtgtggccaaagaatgtgcatgggcaggtagaccatcagtaggttagaactcaagtcccatgatggctttgaaaaaaaattgatgttgcttgatctgatctcagcttccagggcacctcttcagggaaggcttccctgagcttcctgggctaaggtagaagctcctgtcacattttcccagaagcattccaaatttctgcttcatcatcacagtgctcatcatactgcaaaaggtctatctgtttaatcatctgcttccttcaccctaagctttttttttttttttttttttttttttgagacggagtctcgctctgttatccaggctggagtgcagtggctccatctccgctcactgcaagctccgcctccttggttcatgccattctcctgcctcagcctcctgagtagctgggactacagccacccgccaccacacccggataattttttgtatttttagtagagacggggtttcaccctgttagccaggatggtctcgatctcctgacctagtgatcctcccgcctcagactcccaaagtgttgggattacaggcatgagccactgcgcctggccaccctaagcttagatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64063 - DNA, 675 bp, Homo sapiens
gtcacagtcacactaagggccctttggtggggaatgctttatgacgcagggtcgtacacctgtcccagcccacagaacggcacccccaagagggacccctgatgtaaatgatgggctctgtgtagtaatgagatatccacggttcatcgaccatcattgacaccccactcgaggcagatgctgacgacaggggagactgtgtgcacatggggacagggctctatggaaaccttaaactgctcttataaaaatctatttgaacatagtctattatcaagggggggatctgttatgctaaaaatgttagccactacctttcctatcacagattcacatcaccttcccacatgagaagtatcatataaagtttgacccacaaatagaagagtcctacatggttcccaccttctcccgccctgggatgtgggggcccctgggtgctacttgacccgcgtccccagcacagctgggctagggaaagggcaaggaaaatgccttcagcctgggagccactctgtggatcaacagtgaggaattcgaagatttggatgagattgttgctcgctatgtccagcccatggcatcctttgcccgggaccttctgaatcacaagtattattacagttggccctcttccccagcccaggggatcctcgtagagacgaccgcacagaa

SEQ ID NO: 64064 - DNA, 5504 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64065 - DNA, 5921 bp, Homo sapiens
  misc_feature (1724)..(1724): n is a, c, g, or t
ccgggcttgccaggtctctccaccttccggattcaagagattctcctgcctcagcctcctgagtagcctggcttttgccttctttttgaaattatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64066 - DNA, 3558 bp, Homo sapiens
tgacgagtcctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64067 - DNA, 3255 bp, Homo sapiens
gaaataggcttcaagttctaaaacttcattttccactcagctttgctgtaacactccacgaataacataggtccatgtgagtgcacgggcaagaccagcctgggaaggctttatgggggaaaatagctatcagcaaattttcaaaggtttttttcccctttcttgatttatcttattatgagactcatataagttcatcatataaaattcaacatatagaaatattatgcagaaagtggaagtcccccataatcccaccccccagagataactaccataacaattttatgtatactacagtttttctaaattttatttttgctatgcatttactaactacccatttactacaaaaatgggatcatatggttcatagtgtttttgcagtgcatttttcacgtatcaatatattgtggccatctttccatgtcagcacacatagatctacctcattcttgttaatggctgtatagtattccattgtatggaggtgccctaatttatttaaccagttccccattggtggacatttgggttgttactagaagcttatcgttctatatcctgttccttttctgcctttcctccagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64068 - DNA, 2522 bp, Homo sapiens
cattaggctaggtacgaggcccggtggtgaatcggccgaggctttgcagaagagctggagaggcaggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64069 - DNA, 2440 bp, Homo sapiens
tctagaggaccccggtctccacaaaggatccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64070 - DNA, 5352 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatgatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64071 - DNA, 1910 bp, Homo sapiens
tcgatgggtgcgatggcgccggggaagccacggtcaaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64072 - DNA, 4368 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagcccgctcaagattggaccgagctc

SEQ ID NO: 64073 - DNA, 1743 bp, Homo sapiens
tggtggggatcaccggcagcacgaggatgcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgacgaagcaatggtgggcacgaagcagtggttgggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64074 - DNA, 2504 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64075 - DNA, 3313 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgacagtcaagaatgtgacagccccgcacagacgttgttatacgacgac

SEQ ID NO: 64076 - DNA, 436 bp, Homo sapiens
cggagaggatacctgaagcatactctccgagcgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64077 - DNA, 468 bp, Homo sapiens
ctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccaggtaaaaaaccaccagcctctgctcttctaccaatccataattaccttgtagccaagaaatattctagcaaaagtctggcattgagtatccagcacaggtttgaacctcatctcacctggggcctgggaaatccagctcttagagaagggaagatagactctaccttgcttacggttctagaaatactgttttctttag

SEQ ID NO: 64078 - DNA, 426 bp, Homo sapiens
acatgacacagatggataaactgaggggactttgctatggactgagaagcccatcccctcccatggtttttcttctggatggatttgatcaagaatctcagctctggatatgacacatggggcctttaccttcttcccacaggaattcgaagatttggatgagattgttgctcgctatgtccagcccatggcatcctttgcccgggaccttctgaatcacaagtattatcaggactgcagcggtggggaccgcaaggtaagcccagggccctctgaggaatgacacttgccaatcacttaaggatgtacgctttcccttcagtataggggacactcaggcggtgaaggaagtgtacatcatgtgtgcaccagacgttgtgtaccaagcatgctgctatcccaacctctccccctcattctaccccc

SEQ ID NO: 64079 - DNA, 222 bp, Homo sapiens
ctccccaagtgggaatgttgagtgggcagagcagtggcaggttgctaaaaggctgtttgtgggaaggtttaagagccctctgtacaatcatgtgtccgtttttttatccttcactcttttctttccctagttatcttcaggcagagtgagaagctgcagcaatgtctgattttgtggaaagcgaggctgaggagtcagaggaagaatacaatgatgaaggcg

SEQ ID NO: 64080 - DNA, 5889 bp, Homo sapiens
  misc_feature (1692)..(1692): n is a, c, g, or t
cgactccattttcctcggtgggggcttagcgcactggaggagcggcgggcttcagacagttatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64081 - DNA, 418 bp, Homo sapiens
tggtggggatcaccggcagcacgaggatgcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgacgaagcaatggtgggcacgaagcagtggttgggaccgcaagaaattagaggagctgctcatcaaaactaagaaggagaagcccaccttcatcccttatttcatctgtgcctgcaaggaactgcccggcaagttcctactgggataccagccccggggtaaacccaggtgagcactagtgctgagaaggtgct

SEQ ID NO: 64082 - DNA, 6028 bp, Homo sapiens
  misc_feature (1831)..(1831): n is a, c, g, or t
ccgggcttgccaggtctctccaccttccggattcaagagattctcctgcctcagcctcctgagtagcctggcttttgccttctttttgaaattatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatggtgaggagccccagcctcaagcttctccccactattgctaagctttggatagttggattcttgctgatgaaaagctcaggctcagcacagaagttatcacacatgagatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64083 - DNA, 5764 bp, Homo sapiens
  misc_feature (1567)..(1567): n is a, c, g, or t
atagatccccccttccaacatctcatttgtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64084 - DNA, 3261 bp, Homo sapiens
gctcgttgtgctgtacggttcgatgggagtccagaaattaatcggtctcaggaaaaaagatcccagagaagcagagaaaatgatttaaaccagaatggttggattcctcttgatgtgtagctaaggggatttaaggccctgctgaccctcgtttgactctaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64085 - DNA, 3262 bp, Homo sapiens
ccgggcttgccaggtctctccaccttccggattcaagagattctcctgcctcagcctcctgagtagcctggcttttgccttctttttgaaattatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatggtgaggagccccagcctcaagcttctccccactattgctaagctttggatagttggattcttgctgatgaaaagctcaggctcagcacagaagttatcacacatgagatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64086 - DNA, 2443 bp, Homo sapiens
cgccacacctttgtctagccgtgttttgacaccgatggcctgtcctgggcacgaaccgctgtcaaagtggcgccacacctcgcttagttcagggaaattcgccctgctgacagaaggggcactgccacagccctgaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64087 - DNA, 4994 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtga

SEQ ID NO: 64088 - DNA, 4917 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccctcttccagctcccggcaacggcagcagcagcaaagtccaacaggcatgcagcatcgactggggaaaatgcggacagtggtgcaggaaaggcgcgaacggggaaacggagcgggtgcaactcgggccccccagcgagaagagacccaggctgggggagcccccccgggagggaggaggcggcccagccggaaccagggaaagggcgcggccccgcctgcaaggggaggacgggcacggaagggaagggagacccgcctccggggggagctctcctcgtggccgggacttcgc

SEQ ID NO: 64089 - DNA, 1667 bp, Homo sapiens
ggtcccgaaaacgacatagaggcaagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64090 - DNA, 4266 bp, Homo sapiens
  misc_feature (1307)..(1307): n is a, c, g, or t
gcctggaggatgatgattttctcctcaatgaggtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggnctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64091 - DNA, 1742 bp, Homo sapiens
gcctagaggacccctgctgactatttggttgtaggaggacatagaagcggaagcagcagcgaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatgatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64092 - DNA, 1056 bp, Homo sapiens
ggtcggtccctggttaccaggtcttgtgtgaggagcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaa

SEQ ID NO: 64093 - DNA, 2623 bp, Homo sapiens
tccctccgcggggctcctcgtccccgtcacgctgactttccgtgcagtgctgtggtgcgaaaatgcctcgccggtgcgcaccgggtcggcagcctcggcggcgggggcgagattggcgggaggggggcgcggggggggcgcggtaagaggtggcggcgggcagagggtgttttttttcttttccctccagagccggggtttgtaaaccgaggccagagtgtccccgtgggccgagcgcacttttttcttgtccgggtgcgctcagtcactggtgcctgagaggaaacagtggaggcagcggggcaggtcgcctggggcgtcggcgattatattgcggccgagccggggcgcgccgggaaaggccgggagggcggcggcgcgcgggggctgggcgaggccccgcgacccgcgagggaggcggcgcgaagccgaggcggcgggcgcaagagccgggcatgagcgcccagtagctgagcgcccgcggctgcctggcctcagaagcgacgcgcgagcgcgggcgggcggcagcagcgacgtagcccggcggtcccggcggcgagagcagccgccccacaggcccccgcggcagtgcggccgagtcgaggctcgctctctggctgcttagcgccgcccgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctggagc

SEQ ID NO: 64094 - DNA, 1622 bp, Homo sapiens
taaagtaatacagactttttttaaaaaagtaggaaccatgtaaagatgatggggacagaataattgtgaagacctctctgctcctcttgcctgcacaccctatatatatatatcggagctaaagagctctgtgtatatttcaccccgtagacccccgttccacaaacctccagcaacatgcagaggtaccataacatttttaaaacttttattcccccccctttttttttgttttaatcagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctggagc

SEQ ID NO: 64095 - DNA, 1469 bp, Homo sapiens
gaagacaaacctacagtcgcttcctcttcgtctaccaggagctgcttgtggtctcatccacggaaacatttgagaaggagacgacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctggagc

SEQ ID NO: 64096 - DNA, 1602 bp, Homo sapiens
tccctccgcggggctcctcgtccccgtcacgctgactttccgtgcagtgctgtggtgcgaaaatgcctcgccgagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccacaagcagctcctggtagacgaagaggaagacaaacctacagtcgcttccaaactctagagttggaaaaggaatttctttttaacccctatctgaccaggaaaagaagaatcgaggtttcccacgccctagccctcaccgagagacaggtaaaaatctggttccagaacaggagaatgaaatggaaaaaggaaaacaacaaggacaaatttcccgtttcccggcaggaggtgaaggacggggaaacgaaaaaggaagcccaagagctggaggaagacagagccgaaggcctgacaaattaacttctacctttaaaatttaccacagactattaaaactaataatcaccatatgctgtggacaccacctattttctttgttggaaaggaccttacctgtgtttcaagctaccttcatgtcactgctcttgaggttttctgtgctttgagagggatttgggtgtttaaaaaagtttctagtatcacatagaagctgtccttgagctgtcctatggaagggtaatttgatactgaccttgtagctatatttttataatggtttttaatgtctgagctagtgatttgcctcaacaacgtaaacttcctaatgattagcacttaataattgcatataaaatgctttattaattaaacaagtgcacttgaacattttaatatttgtggtgagtaaattaaaaggagtttattaattaaaaaaaattatgtctgcagaatactttatattatttgattacaatgtattatttatggattttttattctttcctttataatgaatagttcgggtgcgttttgtttactcctaaaaggtttctttgcgtattttctaaatgtaatatctcggggaaaatattagaaaagcacgtattagctgaagaatgtaacttgtagtccagctctgcagcttccttaaacttaagaaaaagattgggccagtgacaagaatttaaagacaatgtccaagttgacaattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctggagc

SEQ ID NO: 64097 - DNA, 490 bp, Homo sapiens
ccttaagcctctggatgagagttaagcatgtccaggtagtagtgggtgttttgaaacataaaaggttgcaccctcgtgtgtgcctgtgttaaaaggagcccacgcagccgacagcagcaggagcaaatggcctgctctgatggggacaggcaggaagtccttcggggcatttctgtttcatcacagcttttcctggggctggaagctgatcagtatctcctttggggacctgaaccctttccccgtacgccagatccggaaccaacgcgcctaccacttggagaaagtccggctggagctgaccgagctggaggccatccgtgaggacttcctgcatgagcgggacaccagccctgacaagggtgagctggtcagtgacgaggaggaggatacctgagtgggctccgggacgctgctcttcctgccttcacaaccaaagtgtgcccaaagggtgaaagtgcacttaaaagccagaatgtaaagtgtgtgg

SEQ ID NO: 64098 - DNA, 289 bp, Homo sapiens
atgcaatggagacatttgctcgtttacttttctacaaagtacctccaagagcattttgtgaagagttttggtttcatctttttgtctcctttgattttttttctctctgaagcctgtttctgttgtgttctagtactttcaatctcattaaagaaagagtaagaaataaacaattatttttacaagcatacaaagaaatatattgctcttttatatgaaagagagtttgacaatttgtgtaatgtttcaattgctacttataaaactatctgaaagatgtttatccaaa

SEQ ID NO: 64099 - DNA, 311 bp, Homo sapiens
aggcagatgcagttccagggttggttgattctacaacggtgtcagagctctggattaaattctgttattctcttacatttgcattcatgttgtgggattattgctgctgcttttaaggattgcatctaaaatcaggaaggaatgggggcttttcattattaaagataaaagtatttcccagcagcctctagacttatcggcatctcagtagtcagacctggttcctgtgctgctcaccttaaaactgatcactgtcagaggagaatggggttcttgtgattgacttggtctaatcatggtatcatcccttt

SEQ ID NO: 64100 - DNA, 2728 bp, Homo sapiens
  misc_feature (1)..(1): n is a, c, g, or t
ncacaaacaagctggagcagcccagaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaaaaaaaaa

SEQ ID NO: 64101 - DNA, 3946 bp, Homo sapiens
ccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaaaaaaaaa

SEQ ID NO: 64102 - DNA, 3692 bp, Homo sapiens
caccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaaaaaaaaa

SEQ ID NO: 64103 - DNA, 3862 bp, Homo sapiens
  misc_feature (3847)..(3847): n is a, c, g, or t
ccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacagcatatncagggatcctgtaga

SEQ ID NO: 64104 - DNA, 3892 bp, Homo sapiens
ccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaaaaaaaaa

SEQ ID NO: 64105 - DNA, 440 bp, Homo sapiens
gggtttatcgatgccacaaacattaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaaaaaaaaa

SEQ ID NO: 64106 - DNA, 1594 bp, Homo sapiens
ccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacaggtggggttcccacaaagcgc

SEQ ID NO: 64107 - DNA, 1637 bp, Homo sapiens
ccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacagctcctccaaccatactccaactcatatcatacatgcgat

SEQ ID NO: 64108 - DNA, 2992 bp, Homo sapiens
  misc_feature (1)..(1): n is a, c, g, or t
  misc_feature (2810)..(2810): n is a, c, g, or t
  misc_feature (2924)..(2924): n is a, c, g, or t
  misc_feature (2974)..(2974): n is a, c, g, or t
ncacaaacaagctggagcagcccagaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaaaaaaaaaggtgaatggagctcagttgtgtggggggaccctgatcaacaccatctgggtgggtctccggggccactggtttcgactcaagaactgaggaacctgatcgcngtgcttggcgagcacgacctcagcgagcacgacggggatgagcagagcccggcgggtggcgcaagtcatcatccccagcacgtacgtcccgggcaccaccaaccacgacatcgngctgctccgcctgcaccagcccgtggtccttactgacccatgtgtgcccncttgcctgcccgcggcgt

SEQ ID NO: 64109 - DNA, 3891 bp, Homo sapiens
ccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccgaattgataaggttattactgtgttttgcacaaagtatattagcgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaaaaaaaaa

SEQ ID NO: 64110 - DNA, 3046 bp, Homo sapiens
ccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaaccaccccccccccgcgggcgaccccccccccccactctttggtcacccaggcaaaaacttttttcacctaatccacccgactcctgaaatggtgaatttttggtggttgggttaaaa

SEQ ID NO: 64111 - DNA, 5258 bp, Homo sapiens
  misc_feature (1112)..(1113): n is a, c, g, or t
  misc_feature (1166)..(1166): n is a, c, g, or t
  misc_feature (1452)..(1452): n is a, c, g, or t
  misc_feature (1590)..(1590): n is a, c, g, or t
  misc_feature (4055)..(4055): n is a, c, g, or t
  misc_feature (4087)..(4087): n is a, c, g, or t
  misc_feature (4807)..(4807): n is a, c, g, or t
  misc_feature (4982)..(4982): n is a, c, g, or t
  misc_feature (4989)..(4989): n is a, c, g, or t
  misc_feature (5072)..(5072): n is a, c, g, or t
  misc_feature (5087)..(5087): n is a, c, g, or t
  misc_feature (5104)..(5104): n is a, c, g, or t
  misc_feature (5255)..(5258): n is a, c, g, or t
gcggcggccccgagcgccgcgtccgccgcgctgccccgcagcctgtcccgcctgcgcgagtgcccgggccgctcccgcatcgtgctggcgctcggggccacgcagatggcgctcggatgcctcatcgtggcagtcagcttcgccgcgctggcgctcaccacctcggcccgcgtccgccactcctgccccttctgggcaggcttctcggtgctgctgtcgggactcataggtgtcgtctcctggaagaggcctctctcccttgtgataacctttttcatgctgctttctgcagtgtgtgtaatgctgaatttggctggttcaattctctcttgtcagaatgctcagctagtcaactccctagaaggctgccagttgattaagtttgacagtgtggaggtgtgtgtctgctgtgagctgcagcaccagtcgtccggctgcagcaacctcggggagacgctgaagctgaacccgctgcaggagaactgcaacgctgtgaggctgaccttgaaggatctcctcttcagcgtgtgtgccctcaacgtcctgtccactatcgtgtgtgcgctggccacagccatgtgctgtatgcagatggtctcctccgatgtcctgcagatgttccttccgcagaggtcacatcctgccaaccccacctgcgtgactcctcacggcaccgttctccaccagaccctggatttcgacgagttcatccccccactcccgcctccaccctattaccccccagagtacacctgcacaccgtccactgaggcccagaggggcctccacctggactttgctccgtctccattcggcactttgtatgacgtggccatcaatagccccggcctgctctatcctgctgagctcccccctccgtacgaggcggtggtgggccagccccctgccagccaggttacaagtataggtcagcaggtggccgagtccagctccggggacccaaacaccagtgctggcttcagcactccagtaccagctgacagcacaagcctcctggtgtccgagggcactgctacgccaggttccagcccatcccccgatggccctgtgggcgccccagcaccctccgaacctgcccttccccctggccnngtgtctccagaggatcctggcatgggctcacaggtgcagccaggtcccgggcntgtgtcccgctccaccagcgaccccaccttgtgcacatctagcatggcaggcgatgcctcttcacacaggccgtcgtgtagccaggacctggaagcgggactgtctgaggctgtgcctgggagcgcttccatgtctcgctctgccacggctgcctgtcgggcccagctttcaccagcgggggacccagatacctggaaaactgaccaacggccaacaccagagcccttcccagcgacctccaaagagcggccacgctctttagtggacagcaaggcctatgcggangccagggttttggtggccaagtttttggaacactcacactgtgccctccccaccgaggcacagcacatggtgggtgccatgcgcttggctgtcaccaacgaggagcgcctcgaggaggaggccgtcttcggcgctgangttctggaccaggtatgaaggagccacatttctgaccgtggacaccaacgcctggcgccacagatgttcttggcagaagccatcatgcctgacaaagaggccttcaggcccagcttggcggaggataaatgtgggggggacacccaggatgatctgggggcggtgtgggcagggaactgttaccccctctctcgaggggagccgagcagtgtctctttggggattgcatttcctgcctagcccagtaattcggaaagatgactttcacgtccacagtgaactctctggttttatctggcgtgcagcaccttgaactgagcagtgttgcacaaatgtgaatacagcaacaggcgacacttacgtcacctaaagactcaaagtatctccaaaatcagggccttccaaagcaggagtctcccatcccccatttaacttagtgttcagtggacagagggtgacatcgagtcatgaaacattttctcatgtggctcgatggctctatcattaggcgttcatcacgctctggcctatttcctgtgaaaggaaataggtagtgttagcacagatggcagcctgggcccaactttctgtccacagggctattgtgcaaacaaatgtgcagtgcgggcctctgccatagcccggccccccccagggaacaggccggtgttgcgggggttggaggaacccaccatctcctgggccttgagctcggcctccctccgtggggtgccttccccccctcctcttgggccccctttctccaggctcccatcctgtccctggagcagttgtgtgatccgtaacaacaagtgccgattcccagctcctttgtgtctgagctcacttgattgagctcagcgggtcacagttctgcaggagagaggccggtttctctgagaagtagcccctcctgataaagcaggtccctttgacccagagctgacctttccccgggcatgcggcagcagacacacctgcgcaggaggatcataaaccacttacaaacccacgcgagaagggaagcagacacccaacgtgctgcttatggagaagcagacacgcccagcttggggacagcctggggaccttggactttcttagcccccatccccttgttttctggtggcatcagtggcagctgctcccaacaatggccgtggaacagcgccatccacgagaactttgtgcagtgatggaaatgcctgttcagggccactagcagccacagcccctgagctgcgttgggtgggccctgcggtgaacaaaacagcctagaggccaaggtctccccagagagcccatgagcctggcatgggggcacagggggaccagagggtgtcttccactcctgggtgccagggcagggggctcacgctgctgttccctcggctttgtggggcttgtccttgagctcccccaattccctaatgccactgtggccagtgtgctggggagcttctgtgtggctggaagctgggaagggggtgaggttccaatccaggtgcccagagccttcctccagtcctttatccctgccctgggggctgcggtgtgggactccttcagctgtggtcggctgaaaaggcttcgattgctttagagagctgaaaacacataagccaggccttttgatgacaacctgcacttttgcaggagagacgtactagagatgaatttttgagcactttattcagactataaaacaggaaatctctaattttcctcaagtgggggcttttgaattccctcaaggcaagtccctttgcaggtgaaattaattggtggattttcagaatggccgccctggagccgagcttcagccacgcctgacgccctggcctctgaatctccactgtctctgaggtgcgctggggccacaccgcaggggtttcacctgcttgggggggtccacactagggcttgggggttcacacagcattgtccctgggctgagcccttgggtgggctagagctgcagtcctcagacatggctgcaattccagcgaggccaagaccaccagccacccagtggactcggtctctggggtgttctcctcatgcagccggggcagaggcctactggaccccctcagcctgctgctcagcatccttcccttctctgcagcagggcccggtcccaatggccaatggggctgctgccccagcagtgcctccctgcgggcccctcacctgcaccccaccttcacccagctctgggtttgcgctggtggcagctctgttttgtggatacggaaactgtacccaacttgatgccgctgggctggaaccttctgccccttcgaaatgaggcagtcagggacggggtggggtgcccccatcagccccgctgctcagggccactcatggactctaggagggtccaggttctgggcttcctgggaaggtccccagaagagagaggtgctggtagactagggaatgtgctggcaacttgacccagnagctgtggtccccttggccccggctccacggnatccgggtaccagcagcaagagcccaggccccgggctgcacgtcagctcacagcccaggagaaagctggctgcttcccctccctatgcgtctttcccccgctccaatcatgctccctctgggatctgaaatgggccaactgtggctgctttgggggtgacacgctccttctccaactcagctgggccccgggcatcccctgcccctcccctgagacccaaagggggttggcacctgctgtgacaccaccgttgaccccagcctgggggccacaaggttgctgagtggggagaacatggaccccaactctatggcaagcaagatcgcagaagggggagcatcatccgcaaggacttcaggtctcccttggctggagatgaggatccacattaaatgtttgtaacacaccaggccacagaaagctcgctacacacagatgcttctccccacccatgctgactctcagaggctgctaaggcagaatttataggaaattgttttcaagccaccagagacctgtctgtacaactggaaaggctgtatttatttaatgtacctcaaggtgttttaataatgatccgtgttttaataaaaagaagtatttctggcctctgtgtctctgaggtctaactgggacagaggcaggctgagaggctgtgtaccccagtggccaggggcagggtcctgagaggaccttgcagtagccagccggggagcctgngatacccatgccactcagctgtgcttccagaagccttccggagagggtcaactccggggcagagtggggagggccagggcctggacacacccacgcccgtccacgctggccatggcagcccctccatggacatggcctccaagggctgctgggaggaatgcaggccatggctcanatgtttncttaaatacaggttttttaaagatgtgtatgatttggtgggagtcctgcctgcatgtcctcagctagccagggctctctcccngggacctgcttcccngccttgtcctgggcacngcaggaatgtcccccttggcctcctgagtggaatcccgttccctccagctttgactcaggcgacatttctcttcattccccaaggatgtggccatccctggcattcttgtttgttggccacgtcgagaattgtatttgcttttcattcttnnnn

SEQ ID NO: 64112 - DNA, 4694 bp, Homo sapiens
  misc_feature (1112)..(1113): n is a, c, g, or t
  misc_feature (1166)..(1166): n is a, c, g, or t
  misc_feature (1452)..(1452): n is a, c, g, or t
  misc_feature (1590)..(1590): n is a, c, g, or t
  misc_feature (4055)..(4055): n is a, c, g, or t
  misc_feature (4087)..(4087): n is a, c, g, or t
gcggcggccccgagcgccgcgtccgccgcgctgccccgcagcctgtcccgcctgcgcgagtgcccgggccgctcccgcatcgtgctggcgctcggggccacgcagatggcgctcggatgcctcatcgtggcagtcagcttcgccgcgctggcgctcaccacctcggcccgcgtccgccactcctgccccttctgggcaggcttctcggtgctgctgtcgggactcataggtgtcgtctcctggaagaggcctctctcccttgtgataacctttttcatgctgctttctgcagtgtgtgtaatgctgaatttggctggttcaattctctcttgtcagaatgctcagctagtcaactccctagaaggctgccagttgattaagtttgacagtgtggaggtgtgtgtctgctgtgagctgcagcaccagtcgtccggctgcagcaacctcggggagacgctgaagctgaacccgctgcaggagaactgcaacgctgtgaggctgaccttgaaggatctcctcttcagcgtgtgtgccctcaacgtcctgtccactatcgtgtgtgcgctggccacagccatgtgctgtatgcagatggtctcctccgatgtcctgcagatgttccttccgcagaggtcacatcctgccaaccccacctgcgtgactcctcacggcaccgttctccaccagaccctggatttcgacgagttcatccccccactcccgcctccaccctattaccccccagagtacacctgcacaccgtccactgaggcccagaggggcctccacctggactttgctccgtctccattcggcactttgtatgacgtggccatcaatagccccggcctgctctatcctgctgagctcccccctccgtacgaggcggtggtgggccagccccctgccagccaggttacaagtataggtcagcaggtggccgagtccagctccggggacccaaacaccagtgctggcttcagcactccagtaccagctgacagcacaagcctcctggtgtccgagggcactgctacgccaggttccagcccatcccccgatggccctgtgggcgccccagcaccctccgaacctgcccttccccctggccnngtgtctccagaggatcctggcatgggctcacaggtgcagccaggtcccgggcntgtgtcccgctccaccagcgaccccaccttgtgcacatctagcatggcaggcgatgcctcttcacacaggccgtcgtgtagccaggacctggaagcgggactgtctgaggctgtgcctgggagcgcttccatgtctcgctctgccacggctgcctgtcgggcccagctttcaccagcgggggacccagatacctggaaaactgaccaacggccaacaccagagcccttcccagcgacctccaaagagcggccacgctctttagtggacagcaaggcctatgcggangccagggttttggtggccaagtttttggaacactcacactgtgccctccccaccgaggcacagcacatggtgggtgccatgcgcttggctgtcaccaacgaggagcgcctcgaggaggaggccgtcttcggcgctgangttctggaccaggtatgaaggagccacatttctgaccgtggacaccaacgcctggcgccacagatgttcttggcagaagccatcatgcctgacaaagaggccttcaggcccagcttggcggaggataaatgtgggggggacacccaggatgatctgggggcggtgtgggcagggaactgttaccccctctctcgaggggagccgagcagtgtctctttggggattgcatttcctgcctagcccagtaattcggaaagatgactttcacgtccacagtgaactctctggttttatctggcgtgcagcaccttgaactgagcagtgttgcacaaatgtgaatacagcaacaggcgacacttacgtcacctaaagactcaaagtatctccaaaatcagggccttccaaagcaggagtctcccatcccccatttaacttagtgttcagtggacagagggtgacatcgagtcatgaaacattttctcatgtggctcgatggctctatcattaggcgttcatcacgctctggcctatttcctgtgaaaggaaataggtagtgttagcacagatggcagcctgggcccaactttctgtccacagggctattgtgcaaacaaatgtgcagtgcgggcctctgccatagcccggccccccccagggaacaggccggtgttgcgggggttggaggaacccaccatctcctgggccttgagctcggcctccctccgtggggtgccttccccccctcctcttgggccccctttctccaggctcccatcctgtccctggagcagttgtgtgatccgtaacaacaagtgccgattcccagctcctttgtgtctgagctcacttgattgagctcagcgggtcacagttctgcaggagagaggccggtttctctgagaagtagcccctcctgataaagcaggtccctttgacccagagctgacctttccccgggcatgcggcagcagacacacctgcgcaggaggatcataaaccacttacaaacccacgcgagaagggaagcagacacccaacgtgctgcttatggagaagcagacacgcccagcttggggacagcctggggaccttggactttcttagcccccatccccttgttttctggtggcatcagtggcagctgctcccaacaatggccgtggaacagcgccatccacgagaactttgtgcagtgatggaaatgcctgttcagggccactagcagccacagcccctgagctgcgttgggtgggccctgcggtgaacaaaacagcctagaggccaaggtctccccagagagcccatgagcctggcatgggggcacagggggaccagagggtgtcttccactcctgggtgccagggcagggggctcacgctgctgttccctcggctttgtggggcttgtccttgagctcccccaattccctaatgccactgtggccagtgtgctggggagcttctgtgtggctggaagctgggaagggggtgaggttccaatccaggtgcccagagccttcctccagtcctttatccctgccctgggggctgcggtgtgggactccttcagctgtggtcggctgaaaaggcttcgattgctttagagagctgaaaacacataagccaggccttttgatgacaacctgcacttttgcaggagagacgtactagagatgaatttttgagcactttattcagactataaaacaggaaatctctaattttcctcaagtgggggcttttgaattccctcaaggcaagtccctttgcaggtgaaattaattggtggattttcagaatggccgccctggagccgagcttcagccacgcctgacgccctggcctctgaatctccactgtctctgaggtgcgctggggccacaccgcaggggtttcacctgcttgggggggtccacactagggcttgggggttcacacagcattgtccctgggctgagcccttgggtgggctagagctgcagtcctcagacatggctgcaattccagcgaggccaagaccaccagccacccagtggactcggtctctggggtgttctcctcatgcagccggggcagaggcctactggaccccctcagcctgctgctcagcatccttcccttctctgcagcagggcccggtcccaatggccaatggggctgctgccccagcagtgcctccctgcgggcccctcacctgcaccccaccttcacccagctctgggtttgcgctggtggcagctctgttttgtggatacggaaactgtacccaacttgatgccgctgggctggaaccttctgccccttcgaaatgaggcagtcagggacggggtggggtgcccccatcagccccgctgctcagggccactcatggactctaggagggtccaggttctgggcttcctgggaaggtccccagaagagagaggtgctggtagactagggaatgtgctggcaacttgacccagnagctgtggtccccttggccccggctccacggnatccgggtaccagcagcaagagcccaggccccgggctgcacgtcagctcacagcccaggagaaagctggctgcttcccctccctatgcgtctttcccccgctccaatcatgctccctctgggatctgaaatgggccaactgtggctgctttgggggtgacacgctccttctccaactcagctgggccccgggcatcccctgcccctcccctgagacccaaagggggttggcacctgctgtgacaccaccgttgaccccagcctgggggccacaaggttgctgagtggggagaacatggaccccaactctatggcaagcaagatcgcagaagggggagcatcatccgcaaggacttcaggtctcccttggctggagatgaggatccacattaaatgtttgtaacacaccaggccacagaaagctcgctacacacagatgcttctccccacccatgctgactctcagaggctgctaaggcagaatttataggaaattgttttcaagccaccagagacctgtctgtacaactggaaaggctgtatttatttaatgtacctcaaggtgttttaataatgatccgtgttttaataaaaagaagtatttctgg

SEQ ID NO: 64113 - DNA, 2634 bp, Homo sapiens
  misc_feature (1112)..(1113): n is a, c, g, or t
  misc_feature (1166)..(1166): n is a, c, g, or t
  misc_feature (1452)..(1452): n is a, c, g, or t
  misc_feature (1590)..(1590): n is a, c, g, or t
gcggcggccccgagcgccgcgtccgccgcgctgccccgcagcctgtcccgcctgcgcgagtgcccgggccgctcccgcatcgtgctggcgctcggggccacgcagatggcgctcggatgcctcatcgtggcagtcagcttcgccgcgctggcgctcaccacctcggcccgcgtccgccactcctgccccttctgggcaggcttctcggtgctgctgtcgggactcataggtgtcgtctcctggaagaggcctctctcccttgtgataacctttttcatgctgctttctgcagtgtgtgtaatgctgaatttggctggttcaattctctcttgtcagaatgctcagctagtcaactccctagaaggctgccagttgattaagtttgacagtgtggaggtgtgtgtctgctgtgagctgcagcaccagtcgtccggctgcagcaacctcggggagacgctgaagctgaacccgctgcaggagaactgcaacgctgtgaggctgaccttgaaggatctcctcttcagcgtgtgtgccctcaacgtcctgtccactatcgtgtgtgcgctggccacagccatgtgctgtatgcagatggtctcctccgatgtcctgcagatgttccttccgcagaggtcacatcctgccaaccccacctgcgtgactcctcacggcaccgttctccaccagaccctggatttcgacgagttcatccccccactcccgcctccaccctattaccccccagagtacacctgcacaccgtccactgaggcccagaggggcctccacctggactttgctccgtctccattcggcactttgtatgacgtggccatcaatagccccggcctgctctatcctgctgagctcccccctccgtacgaggcggtggtgggccagccccctgccagccaggttacaagtataggtcagcaggtggccgagtccagctccggggacccaaacaccagtgctggcttcagcactccagtaccagctgacagcacaagcctcctggtgtccgagggcactgctacgccaggttccagcccatcccccgatggccctgtgggcgccccagcaccctccgaacctgcccttccccctggccnngtgtctccagaggatcctggcatgggctcacaggtgcagccaggtcccgggcntgtgtcccgctccaccagcgaccccaccttgtgcacatctagcatggcaggcgatgcctcttcacacaggccgtcgtgtagccaggacctggaagcgggactgtctgaggctgtgcctgggagcgcttccatgtctcgctctgccacggctgcctgtcgggcccagctttcaccagcgggggacccagatacctggaaaactgaccaacggccaacaccagagcccttcccagcgacctccaaagagcggccacgctctttagtggacagcaaggcctatgcggangccagggttttggtggccaagtttttggaacactcacactgtgccctccccaccgaggcacagcacatggtgggtgccatgcgcttggctgtcaccaacgaggagcgcctcgaggaggaggccgtcttcggcgctgangttctggaccaggtatgaaggagccacatttctgaccgtggacaccaacgcctggcgccacagatgttcttggcagaagccatcatgcctgacaaagaggccttcaggcccagcttggcggaggataaatgtgggggggacacccaggatgatctgggggcggtgtgggcagggaactgttaccccctctctcgaggggagccgagcagtgtctctttggggattgcatttcctgcctagcccagtaattcggaaagatgactttcacgtccacagtgaactctctggttttatctggcgtgcagcaccttgaactgagcagtgttgcacaaatgtgaatacagcaacaggcgacacttacgtcacctaaagactcaaagtatctccaaaatcagggccttccaaagcaggagtctcccatcccccatttaacttagtgttcagtggacagagggtgacatcgagtcatgaaacattttctcatgtggctcgatggctctatcattaggcgttcatcacgctctggcctatttcctgtgaaaggaaataggtagtgttagcacagatggcagcctgggcccaactttctgtccacagggctattgtgcaaacaaatgtgcagtgcgggcctctgccatagcccggccccccccagggaacaggccggtgttgcgggggttggaggaacccaccatctcctgggccttgagctcggcctccctccgtggggtgccttccccccctcctcttgggccccctttctccaggctcccatcctgtccctggagcagttgtgtgatccgtaacaacaagtgccgattcccagctcctttgtgtctgagctcacttgattgagctcagcgggtcacagttctgcaggagagaggccggtttctctgagaagtagcccctcctgataaagcaggtccctttgacccagagctgacctttccccgggccattgcgggcaacaagaacaccacccttgcgcccagggagggaatccattaaacctcccttttccaaaaactccatctccttaga

SEQ ID NO: 64114 - DNA, 1760 bp, Homo sapiens
agcgcggataaatgtagcgccgcggcgcgggccagcagctctgcgaggggccggagcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgtt

SEQ ID NO: 64115 - DNA, 1738 bp, Homo sapiens
cacccggtgttcgcaagtgcggctcaccaagggagatccaagggggcaaaaagttatgtataaatccgagagccactggggaaagagggtcgtggtattgtaagcccagccggtagtgcccattctttttggggttaaaggtatgtcggatttagttctaggtgtgacggctgtgtgtgtgtgtgtgtgtgtacaaggctgtgtgcatctgcggtgtcagtgtgtgactttgggtatgtttgtgtgtcggtgggaacgtgttaggtccacgtgccggtgggtgtatgtgaatgtgtctggttgggtggcctcctggcctacctttgtcatccctggggcccgacagctctggggtctggccaggccgctccagggcagtgggtgagcgccgctcttcccgctcgcaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgtt

SEQ ID NO: 64116 - DNA, 1471 bp, Homo sapiens
cacccggtgttcgcaagtgcggctcaccaagggagatccaagggggcaaaaagttatgtataaatccgagagccactggggaaagagggtcgtggtattgtaagcccagccggtagtgcccattctttttggggttaaaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgtt

SEQ ID NO: 64117 - DNA, 1683 bp, Homo sapiens
cacccggtgttcgcaagtgcggctcaccaagggagatccaagggggcaaaaagttatgtataaatccgagagccactggggaaagagggtcgtggtattgtaagcccagccggtagtgcccattctttttggggttaaaggtatgtcggatttagttctaggtgtgacggctgtgtgtgtgtgtgtgtgtgtacaaggctgtgtgcatctgcggtgtcagtgtgtgactttgggtatgtttgtgtgtcggtgggaacgtgttaggtccacgtgccggtgggtgtatgtgaatgtgtctggttgggtggcctcctggcctacctttgtcatccctggggcccgacagctctggggtctggccaggccgctccagggcagtgggtgagcgccgctcttcccgctcgcaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgtt

SEQ ID NO: 64118 - DNA, 1869 bp, Homo sapiens
cacccggtgttcgcaagtgcggctcaccaagggagatccaagggggcaaaaagttatgtataaatccgagagccactggggaaagagggtcgtggtattgtaagcccagccggtagtgcccattctttttggggttaaaggtatgtcggatttagttctaggtgtgacggctgtgtgtgtgtgtgtgtgtgtacaaggctgtgtgcatctgcggtgtcagtgtgtgactttgggtatgtttgtgtgtcggtgggaacgtgttaggtccacgtgccggtgggtgtatgtgaatgtgtctggttgggtggcctcctggcctacctttgtcatccctggggcccgacagctctggggtctggccaggccgctccagggcagtgggtgagcgccgctcttcccgctcgcaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgttaaaaaaaaaaaaaaaaaaaaaagccaagaccaccaagaagcggccacagcgggccacatccaatgtcttcgcaatgtttgaccagtcccagatccaggagtttaaggaggctttcaacagtgttctacccc

SEQ ID NO: 64119 - DNA, 1238 bp, Homo sapiens
gtcatccatctgaaccagctcagcagcatccgcaacatctacaatggccttgactttttatttaatggtggccctagtggtgctcagctacaagtcattcagctctctgggctgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggaagtcctgtgtgatcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaatgagacctggtacaacacggaaatgattctcatagactaatacagcagtctacactttgacaagttgtgctctttcaaagacccttgtttctgccaaaaccatgctatgaattgaatcaaatgtgtcaagtgttttcaggagtgttaagcaacatcctgttcagctgtatgggcactagtcccttacagatgaccatgctgatggatctattcatctatttatttaaatctttatttagttaactactatagggacttaaattagttttgttcatattatattatgtgaacttttacattgtgaattgtgtaacaaaaacatgttcttatatttattattttgccatgtttattaaatttttactatgaaaaaattctttatttattctttaaaattgaactccaacccatgaattgtgcaaactgattaaaggaagtggtgcacttgcaaacaagctctactatccctgaggaaataccagagactctggaaggtgatattcaaaaagcaaaaagcaaaattctaacactaattgaacctgacattaaaacagcacagatgactgctaccatagattcctgcctttcaaacgcagggcaagacattcattggtcatacgtagaaggc

SEQ ID NO: 64120 - DNA, 221 bp, Homo sapiens
atagacaaagtccttcccactagaacttacattccagtgggaagaattagaagcctcaggaattccattgcttacttttagttgttacttcaaaagtacttacatttaatttgattattaattatttgtcatgagcttcattttattacattttgggcacagtatgtgaattgtgtttcgttcctttaggaaaaggaaaaataatcactctttaaaaagta

SEQ ID NO: 64121 - DNA, 445 bp, Homo sapiens
agcgctttaagtagacacaatgccccagagagacatccgatcctcaggcgggtgcaccagccacctgggccccttactctgcctgtggtcccactcctggcctttgctctgggattcctgctctctgggatgcctggacttgtctccctctgtccccgggataggaagcgtcgtctttgccgagggcccagggctgctctttgtgttttcaggggttcgagtctcctctctactgcttccctgtagtatgatcttaggcaaattatttaaccccccgtacctcagtttacccacctgtaaaaatgggctaatagtatccaacctcagggagctgttgggaggcttaagtgggttaatttatgcaaaggacttagaaccctgcctggtgcatagtaacaattattatctcccctgttagtctttaaactccttcaagcctccagca

SEQ ID NO: 64122 - DNA, 472 bp, Homo sapiens
gtagtttcctggacgtatcaaatggttctttatagtcatatttcctgaaaataattttgctgtagcaatagtaactgccagttcttttgttccattgttaaaactgatgaacttcttttctgtgactcaggtgagaaaaaccagaagcttgaagaccatagtaagacatttttataaattctgggggcttggccaggcgtggtggcttatgcctgtaatcccagcactttgggaggccgaggcgggaggatcatgaggtcaggagattgagaccatcctggccaacatagtaaaaccccatctttactaaaaatacaaaaattagctgggcgtggtggcacatgcctgtagtcccagctactcgggaggctgaggcaggagaatcccttgaaccagggagctggaggttgcagtgagctgagatcgtgccacagcactgtagcctggaaacagagcgaggctccgtctcaaa

SEQ ID NO: 64123 - DNA, 1288 bp, Homo sapiens
gcacatggtctgtcccactcatcctcagagtatccgttggttttacttcatgttcagactgcagtgttgttaaagaaataaagctacagtgttttcagaaggatttgttatattatacttcatgttcccactgctccaggctaagcgtctcctctgggctccattgtttaatgcaggacaaagccaggttttctggcagcttccttttcatagcaattctcagtagaggtatagaatgagacctgcctaccttcttgggtgtttattaccccatttgtggattttactttaacttctgttaccttaaaaaaaaaaaaaaaagttggtgaggaaggcaagaaataaaagtgagtatgacagccagactgggtagtgtggatttttagcgttggtatttttgaatgtccagattttccaaatccttccttccttcctttcaacagttatagcaacaggtccagtgcttcttcattggtcacattattttcctctggttttgaaggacacttaacagaagaatgagtttacagtatggatagctcctcctagatttcaagggagtaaattcccccctctcattttgtcacaatgtttgcaatgctttttttttgcttttttttttttccttttttcttttttgagacagagtctcactctgtcacctaggctgaagtgcagtggcgtgatctcagctcactgcaacctccacctcccgggttcaagtgattctcttgcctcagcctcccgagtagctgggattacaggcatgtgccaccatgcctggctactttttgttttttcagtagagacaggatttcaacatgttggccaggctggtctcgaactcctgacctcaagtgatctgcctgcctcggcctccaaaagtgtgcaatgctttttttggttgcttccctatttggtaaaacaatgctgtgggtttttttgtttttttttttttcttgctgggatccggttttgagccaccaggcccgggccagttttttgggttttctggtaagagcacaggagtcttcacgatgtgcgcctcaggctggctctctcaaatttctgggccctcagggcgcctcctctcctgtgccaagagcctctcccaaaggtgcggggattcacgggcttgacgccacatttgcccagccccttgcctttcctgagatagcgtgggccataggtgggtgtttgccgtttgcgccaggcttccagctaatttcttaagcgtgtcaatacccacggcctttgagtttctccccttagaattagttgccctata

SEQ ID NO: 64124 - DNA, 405 bp, Homo sapiens
aaacaacattttgcctaacactgcagagcctctgaatcccacaattgagaatccaaggtagaaaggcctgcactaatagaaattttgatgtttttctcaggtaatttcccaaatggggatacagacaagtatttatctgacaccattcgacctttgagaaggcacttgaactagaattcccaggcgtctggatgcttttctgcttgtatttgagaaatgaaaatctcaaagactttcagattagtgtatggttgcagaacttggaaagcagtacagttaaatcagttatgactgcttagtccttgtattaggctctatgggccaaaaggtattgatttttgtgtagagcatcacccccaaattagctagagggtaaatttaaatgtcaatggacagtttttaaaa

SEQ ID NO: 64125 - DNA, 420 bp, Homo sapiens
aaacccaatgtcttgttcttcttctcaacccaattctaaaatgagggttttctctaagatgcaaattctaacacacacgaataatcttctcatataaggttgatggtttctctaacacaaaactcttaacagtctggatataaagtggctgtactaggatgtattcaatttcataaagttctctacagcttgtagctccattagaaacaaatctcagcgtctcaaaaaccctcagaaaactaggaatagagggaacttcctgaatttgattaagaacatctacaaaaccctgcatttaatactatacttaatggtgaaaaatggaatgctttctttctaagattgggaacaaggcaaggatgtccactctcaccactcttattcaacatacaactgaacattctaggcagtgtaacaggc

SEQ ID NO: 64126 - DNA, 788 bp, Homo sapiens
acaattcaataatattactgacatttgtttctggttcacagcctcatcttgtgaaatgctttgaaaatataaaacaattattgatatggaaacaagacattggccctcctgctgtaaaaatgctaatatctgctgaaggggaaggtctcgtgctgccaaagtatgataaatgttacaaactgtttagattctgtacaacgtcattatttaaaatctctgctttgaaatttttgatatattataaaagtgcgctaagcaaactgtttcttcaaagattatatccttacgtaaatatacttttgcctttccatattccctacaatacataatctcacctttgctctaattaaaagttgagaaagcagtcttcaaactcctgggtgcattctaatttgcacttacattttgttctgtcattaaattctgccttaagtttcctactctctttttagtgctttttccctttttggttttagtatatgaatatagataagaagaaaattggctatttggagttgttgatgctactcccactactgcttctgctgatctctggtttcactgtggtttgctcccaggcaataatgacaaactaggtccttccattacactggtcattgcagccaagaggtctctaaccctggatgtccgagtaagtgattaaaaaatgtggcccaccttttttacaaatctatcaccgtgtaagacacgagagcgggggttaaccggccacttggggcggggatccgcgggggacgcaggggtttaaaaaaaaaagcggggcgaaa

SEQ ID NO: 64127 - DNA, 334 bp, Homo sapiens
ctctatcttcataattccatctatagatgacatatcagctcagttagaagagtctcaagtcatacttgcaacaattaaaggatctccccacattgggcccattaaggatcttgtgaatgaatgggatcaaaacttgactctcttctcttacacccttgaggaatggatgaattgtcaaagaaattggctttatcttgaaccagtctttcattcttcagaaatacgaaggattaccttgaagttaaaagattaattttcccaagattttactttcttagcaatgccgagcttcttgatattctagctgatagcagaaatcctgagtctgtacagg

SEQ ID NO: 64128 - DNA, 1218 bp, Homo sapiens
aaagaagtcaaactgtctctcttcactgccgatatgattctatacctagaaaaccctaaagactctgccaaaaggctcctggaaccgataaatgacttaagtaaagtttcaggatagtaaatccatgtacaaaaatcagcatttccaaacacagtaacattcaagctgagcaccaaatcaagaacgcaatcccatttccaatagccacggaatgaaatacctaggaacacgtataaccaaggaggcaaaggatctctacaaggagaaccataaacgagatgctgagtcccagcgaggtcggaggtgccactgagccctcatcgtggtgccgttcccgctctgggttatttatctgttgctcatctcagctgttgttcctacctcaaatttcaagtccctcaacaaatataacagaaccacttctagaatgaacctttgagaagggaggtagcagtgcattgtataggaattggcattctatagaaaaccacagaaactggaaataatgaagggttgtctcttggttttaaaataatgtatacacctaaatcatccccttatgatactcatcctctaacagcaattgaacttcaatacaatgagtcattcctgagttcactcgcttcacattacatatgtttctctataaccacaagcatcctggcttggtagtgctcccacagcaccaaaaatccctgaggaggctgacaaacattgtgctgactcatgctggagacaagccacagagaacttccatcccccaccacatcagccacggagccagcccagcctctgcccacccaggcctcagtccccagtgttaagttctgatccctgatgctggcctgccagtggccagtcaagattctctttctgaaagctagtattttatgaggactgactgttgctagacattacactaagcacattatatgttgtacttcattttaccctttcaacaatcctattagtagcttactgtgggtctgcaaagccttactcaaaacatatagggctagaggttctcaggattctgaattttaaaaaaaatttgtaaaggcttatggctctcaccactgttattcaacgttgcattaaagtttctacccagagaaggcaataaaaggaaattaaagctatacagattggaagtgaagaaataaaagtctttattctcaagaatacaagacactatgtatagaaattgtaaggaatgca

SEQ ID NO: 64129 - DNA, 540 bp, Homo sapiens
tactactactagcctactactaaattcgcggccgcgtcgactctaggttcatctttcaatgttttgactgttacgaccttcaagaaggaggaactctcgcttcacttcttcctcctacgcctcaggcaaatacttattttcgtcaaccctgagttagaagcatccagaaaaagaatctgagagaatgaacttcccacttagccaagttgactcagagaaaaaaaaatcacgaagattacttgcttgcgttcaagtttcattgaagcttcagtgtatcaaagtcatgaaattaatagaatgtatgttttagggagattctgattctaaaatattttgatggaatttaatttctcaggccagaagagattttagttaagcattgattataattgacaagatttagtaatcagagaggaagatcgatgtcaatatttcacatttttatcaatataataagcatcaataataagtgagacattgtggttacagaaaaacaattatatgaactgtatactaatataatatgctttctcagtcaaa

SEQ ID NO: 64130 - DNA, 181 bp, Homo sapiens
ttctgtaaactgtgcatggctattgtcttgcagcccagaagctaagggggatgttaaacaaatatgcaagaaatgcatcactctgtatcaaaggtttagagggagaaagaggaagaaggaagagtcaattattttagaacgctgatacaaaggagtagaaagatttagctttaccatctga

SEQ ID NO: 64131 - DNA, 232 bp, Homo sapiens
catgaacacatattataaaagtacgtagggtcaaaggaacaggaccaccagcattcaaaagcagctctgtcaactaggcaataaaacactctatagcatgtgtctctgttgtccattgttgaatacactggcaggaactttgaagtgaaaaaaaaggtaagataggaaaaaaggagctattactccttttattttctctgtttaaaattaaacaggaaaacatcaattgttg

SEQ ID NO: 64132 - DNA, 2623 bp, Homo sapiens
agcgggggagtgtggaaagcgccgcatcccgggtgggaggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgcgcgcgaagccgagtcccgggcgggtggggcgggggtccactgagaccgctaccggcccctcggcgctgacgggaccgcgcggggcgcacccgctgaaggcagccccggggcccgcggcccggacttggtcctgcgcagcgggcgcggggcagcgcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaatttttggtgaatgtgggtagtcattcttacaattgcactgctgttcctgctccatgactggctgtctgcctgtattttcggactttgacatttgacatttggtggactttatcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattatttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggagaaagct

SEQ ID NO: 64133 - DNA, 2093 bp, Homo sapiens
agcggaagtagttgagtgtgacgggtgcatcggttcgggtcgaaggaaatgaggctggagaggaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaatttttggtgaatgtgggtagtcattcttacaattgcactgctgttcctgctccatgactggctgtctgcctgtattttcggactttgacatttgacatttggtggactttatcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattatttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggagaaagct

SEQ ID NO: 64134 - DNA, 1941 bp, Homo sapiens
agcgggggagtgtggaaagcgccgcatcccgggtgggaggcgaggcttccccttccccgcccctcccccggcctccagtccctcccagggccgcttcgcagagcggctaggagcacggcggcggcggcactttccccggcaggactgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacacaacttcttcaggaacaacgttcagcacttgcctgtacactacacacagtgccctggacagtactcatgacggcgcagaagccacaaggatcagtgcaccagcagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaatttttggtgaatgtgggtagtcattcttacaattgcactgctgttcctgctccatgactggctgtctgcctgtattttcggactttgacatttgacatttggtggactttatcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattatttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggagaaagct

SEQ ID NO: 64135 - DNA, 878 bp, Homo sapiens
aaaaatagtgattaaaaaaaagaattcaaggccagaaccacagcccttaaaaacaaaaaaaaagtattcatatgcaggaaggtcagatgggtaagtcgtttgcatgaataattaatgccattccaagggcagtcttagaataaacaacccagatgaagtgtcaaactatttggtgttcatcaatttttctgttactttgaaaccctgctctaaccaagtacttttcaacccagtcaaaagtggctgcatctatgtgaaaaatttgcataagttaattaattccttttaaatgttatttattattattgtttttaatttagagatggggtctcactatgttactcaggctgctggtctctaactcctggcctcaagtgatcctccctcctgggccttccaaaatgcagggattacagatgtgaaccactgtacgcagcctacattttatttatgcacttaatttttatattaatgcatagacacatattaaaacgacatatcaaagtgaggtctcaagctgggtgtagtggtgcacatctgtagtcccagctactcaggaggctgaggcaggaggattgtttgagcccagtagttcaagatcagactgggcagcataaggagaccccatctttcaaacaaacaaacaaacaaaaaaacaaaatggcctcttctgcctcatccagccccctctctcactccaactctcactcaccatgggcaaccacactgaaacttagctttttgatctggtaatttgccaacatatttctaaacactatgtttatcctacgaatgtcttattatttcagttttatatactttatgtggaaaatgaagacttaatccttatacctgccctcccacatgtttccttcccc

SEQ ID NO: 64136 - DNA, 1796 bp, Homo sapiens
gttttcctagagatgtcagcctacaaaggacacaatctctcttcttcaaattcttccccaaaatgtcctttcccaacagctctcctgctgctaatacttttttagtagattccttgatcagtgcctgcaggagtgacagtttttattccagcagcgccagcatgtacatgccaccacctagcgcagacatggggacctatggaatgcaaacctgtggactgctcccgtctctggccaaaagagaagtgaaccaccaaaatatgggtatgaatgtgcatccttatatacctcaagtagacagttggacagatccgaacagatcttgtcgaatagagcaacctgttacacagcaagtccccacttgctccttcaccaccaacattaaggaagaatccaattgctgcatgtattctgataagcgcaacaaactcatttcggccgaggtcccttcgtaccagaggctggtccctgagtcttgtcccgttgagaaccctgaggttcccgtccctggatattttagactgagtcagacctacgccaccgggaaaacccaagagtacaataatagccccgaaggcagctccactgtcatgctccagctcaaccctcgtggcgcggccaagccgcagctctccgctgcccagctgcagatggaaaagaagatgaacgagcccgtgagcggccaggagcccaccaaagtctcccaggtggagagccccgaggccaaaggcggccttcccgaagagaggagctgcctggctgaggtctccgtgtccagtcccgaagtgcaggagaaggaaagcaaagaggaaatcaagtctgatacaccaaccagcaattggctcactgcaaagagtggcagaaagaagaggtgcccttacactaagcaccaaacgctggaattagaaaaagagttcttgttcaatatgtacctcacccgcgagcgccgcctagagatcagtaagagcgttaacctcaccgacaggcaggtcaagatttggtttcaaaaccgccgaatgaaactcaagaagatgagccgagagaaccggatccgagaactgaccgccaacctcacgttttcttaggtctgaggccggtctgaggccggtcagaggccaggattggagagggggcaccgcgttccagggcccagtgctggaggactgggaaagcggaaacaaaaccttcaccgctctttgtttgttgttttgttgtattttgttttcctgctagaatgtgactttggggtcattatgttcgtgctgcaagtgatctgtaatccctatgagtatatatatatatatatatatatatatataaaaacttagcacgtgtaatttattattttttcatcgtaatgcagggtaactattattgcgcattttcatttgggtcttaacttattggaactgtagagcatccatccatccatccatccagcaatgtgactttttcatgtctttcctaacacaaaaggtctatgtgtgtggttagtccatgaactcatggcattttgaatacatccagtactttaaaaatgacatatatatttaaaaaaaaaagattaagaaaacccacaagttggagggagggggacttaaaaagcacattacaatgtatcttttcacaaatgaatttagcagttgtccttggtgagatgggatattggcgatttatgccttgtagcctttcccttgtggtgcatctgtggtttggtagaagtacaacagcaacctgtcctttctgtgcatgttctggtcgcatgtataatgcaataaactctggaaatgagttca

SEQ ID NO: 64137 - DNA, 450 bp, Homo sapiens
  misc_feature (447)..(447): n is a, c, g, or t
cctcgttttagggcttaactcacaatgaatgggataatttgcctatttcttatgataaacctgtgatatttactctcgcttgatgtctttggtttcatttgtttactgttaaaggattctattagtaatagaattggtcataagtactttatgtaactttttaactgacaagagaacattatgatagatttggcctctcttccttaagtttaaaacttaagcaatttatttaaacagctaagacagaatgaaacagattgtctcattgagcaagttttaaagaatgatgacatgtaagtataacttaaggcctgaacagccttgttgatagcttttttgttttttgagatggagtttcactcttgttgcccaggctggatgcagaggttgcagtgagccgagactggccactgcactccagcctgggagacaagagcgagactcccnctc

SEQ ID NO: 64138 - DNA, 1416 bp, Homo sapiens
gcctcccaaagtgctgggattacaggcgtgagccaccgcacctggcctgtttattctcttaagagagaaaatgaggggattagtggactgtagttctggacaaggtggaaaactcttaaagtggaagtattggggcaagtgctctgacaggctaggatggtgcagtcagtcacttcacccagaaatcagtagaatgttaacagttcagactcaaaccttgtgaaaaacaggttctagaaaggaaatccctcacagcaactggcaccataatcaagacagaatttttgcagaataaatggagttacctgctttcagccccaggtcgtagctattgtctgccctgctgatatgtgataataatttgtgatcctgttgtcttaaaatggggtcactcatctccagtagaattaagtccacagtgaagttgtccccccatccccagagataaacatatatgaatgaactcacgtgataacaactactgctgcctgggatcatgagagacctgaactgaactgataggaagtgaaaggtggctgaggtaatgagaatagacccatctgcagaggatcatagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactgcctgtgtgtagaatgataattgcacaattgatagtgtgaagacctcttgataaatggtgaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgagtgtctctccaaggtctaaacaatggaagactgtagaagatgttattcattaagatatctcaagaatgtggaagactattattcgcttctaaagggacaggacttcatagggcacctgaagaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtaagtttttcatatatgcttgcaaagggttgtaaaactttattgtgattattcttgctttaagctgaaacttccctaatctttctttagagattgtggcatagcatgatagtttcttttccatatccaat

SEQ ID NO: 64139 - DNA, 447 bp, Homo sapiens
ttaagacggagtctcactctgttgcccaggctggagtgcagtggcgagatctcggcttactgcaagctccggttcacgccattctcctgcctcagcctccggagttactgggactacaggcgcctgacaccgcgcccggctaattttttgtattttttgtagagatggggtttcactgtggtctcgatctcctgactttgtgatctgcctgcctcggcctcccaaagtgctgggattacaggcatgagccactgcgcccagcaataattttctatttaccaaaatttagataagcataattcataaaagatggatttttttgttttaatatgaaacctctgaactttactttgttctctttcaaaaaagtatttattccctcaaagaaagatcacattctaaatgtagaacttaaaactcagaaataatggaataacataaagaaac

SEQ ID NO: 64140 - DNA, 504 bp, Homo sapiens
ttaatgaataaggtaaggaaacatctcaaaggtcatctagtaagctcattgtttgagggtgtacatccaccacctcttggctttggagttgttcatcctgctagacctgttgcacatgtttctaagttttacaagattgttagttgaattggcaaatgtaaagacccagttcagagcatctgctataaagccattcttgcaaagtgtccattctcccgcaacttgctgtgtgcaactaattcagctggatccggaaaaggaccctcagcctaggatatgttggcttttctacaggagaggaattactatttttctcccatgggatactaggggcaggcactatttcagtgctattcaagcacttgttaagagcactagctttcaggctagcctggtagcacatgcctataatcctagcactttcggagaccgaggtgggcggattgcttgagcttaggagttcaagaccagcctgggccacatggtgaaaccccttctctacca

SEQ ID NO: 64141 - DNA, 828 bp, Homo sapiens
ggagtgaataatgaattgtttctgctatactaagacacatagccagcctacttgaggagctattttcaaatgaccaagacccaggaggcccaggctaaactaatttagccctaattctacaagcacagcggtgaacagaagatctttaaatcttgtggactcaaatatctcttcagaatattaatattcacacagcatgcagcagactgcctataccttggcaatgctaatgacattgacatgtctacctccctgagcccagatcaccataaaaccaagcctaaactaaaagtgagcaaccaaaaaacccccagatttttatataagtcatgggacgaataaaatgatttaacaattgagccatatttttaaaaatacttgcaaaatatgcatatagataagtgctagtcccttcacttaacaaacttaaaagtcccatgccaaaaacttctaagaatcatttccaagtaaatacagagagaatagggaagtgccctaaacatatttttggaattcagttcttttctgatcaactctagcttgtcggaataaaagaacgtaaaaaagtataagaagaatacatttctttataagaataatacaatacctttgaatacaattcttcttatacttactctataattgtacttactctacagttttctgcaaacgtacttactctacaattttcatcatctaaaatcaaccagcaaacagtacctgcttactgtgggtgcttttcaacgttacctgttaaaaaaaaacgttgaggtctaatttacatttacttcttttaataaatataaagctaaggatcattggaatgaa

SEQ ID NO: 64142 - DNA, 843 bp, Homo sapiens
tagtcttgtttacctgggatgaggagaaacaaaactattgctattctgattagaattatgtattcctaagagtggctgcaatggcaatatttggtttaaagttgcttagctactgtataaactttcacacaatgtctttaatagctctattgagatggaatttacatacaaagaagttcacctgcttaaagtgattttcaatagattttagtatatttagtagattttagtatattgactatcataaccttttgatgatcactttcccctctccaaccgtaaacaaccactagtctactgtctgtatagacttaccagttctggacattttatttgaatggtgtcatacaatatttcataataagtttttaaaaaaatacaactttggatccagaattggtttggccttcatcataattagagttaggttcaagtgtattctatatataacaatataatttttaagaagtgataagtttctgattccatgggatactttaaagaaactcttcagtaaatttaatagaggacaaaagtatcttttaatggaaaatggtgcagtgtatattagagtagggcttttcaaagtgtgttgtcaggtctagcaccattagcatctcttgcgaactttaattaaaatgtaagttcttggctgggtgtggtggctgacacctgtaatcccaacactttgggaggccaaggcgggagggtcacttgagttcaggagttggagaccagcctgcaacatggtgaaactgtgtctctacaaaaaatacaaaaattagccgtttgtggtggcacacacatgtggtcccagctactccagaggctgaggtggaaccg

SEQ ID NO: 64143 - DNA, 323 bp, Homo sapiens
  misc_feature (171)..(171): n is a, c, g, or t
gatcttcatctatattccatcctcgttatttctagcaagtctatgaaatttcttacattaatagaaataatgtattaatattcagcaatgtgctaaacattgttgaaacattgtctcaatattactcttggaagagctctaaggtagacaatatttccaatatatgagtcntgaggaaactgaggaatggaaagattaaacaacttgttgagggtagcataattgtaaatggtgaagacataatacaaatcctaatatctatgactctaatgctttaaaaaatcattatatacactacgctgtctctgatgtgtgaatctacc

SEQ ID NO: 64144 - DNA, 4045 bp, Homo sapiens
aagcacaagctgggacgcaatgtgtgtccctctatccctacattgactttgcgggggtggggatggggtgcggggtgagtgagggaggactgcaagtgacaaacaggattcgtcaaaagagaggtgtattaaagtgccgatcaaatgtaatttaacagctaaactttccctccttggaaaacaggtgattgttgagtatttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccaca

SEQ ID NO: 64145 - DNA, 4490 bp, Homo sapiens
aagcacaagctgggacgcaatgtgtgtccctctatccctacattgactttgcgggggtggggatggggtgcggggtgagtgagggaggactgcaagtgacaaacaggattcgtcaaaagagaggtgtattaaagtgccgatcaaatgtaatttaacagctaaactttccctccttggaaaacaggtgattgttgagtatttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcaaaaaaaaaaaaaaaaaaaaaaaaaaaaaaaaaaaaaaaaaaaaaaaaaaaaaaagagaaagaaaaaaaagaaaaaaaataaagaaaaaaagagaagagaaaaaaaaaaaagagaagaaagggaaaaaggagagagaggaggggagcggcaggacggagagcacgaaacaaaaacaaaagaaacgtcgccagcgcaagaaacgcaccgaaagaaaataccaaacacataccgcaagacatgggagtcggcgaaaaaacagacgacagaagcaagagaagcacgaggctgcgacaggacgcaaaaaagaggaacagaagcacacgaagaggaagatccacaagacagcagggagacaagacaaaagcaacgccgaccggagaaaagaaacaagcaagcgcagcgacaagacgccgacaaaagacgaagatcggaaagggagagcagagaaacaaaacaacaaagaagaatactgcgaacacgacagcgatgctcgaatatacaagatactaacaacagaagacgcagacgaaagagtaagcaaaacaagacaaaagtgacgagtggaggacgaggagcgagagagagcagacgaggaggaccgacagctggagacgaggacaggagagccagacgcaaagcaccaaacgaacagaagctcgtagcacgaagataactttgagatactgagagcgaactgacgagggacggagcaaacagagagcatagacagagaacaggcacacagcgacacacagggcaagaatagctgaggataagcaagcagacaacgagccgatccagcggagggagcacgacagacagaagggatagacagagagt

SEQ ID NO: 64146 - DNA, 4365 bp, Homo sapiens
aagcacaagctgggacgcaatgtgtgtccctctatccctacattgactttgcgggggtggggatggggtgcggggtgagtgagggaggactgcaagtgacaaacaggattcgtcaaaagagaggtgtattaaagtgccgatcaaatgtaatttaacagctaaactttccctccttggaaaacaggtgattgttgagtatttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccacaaaaaaaaaaaaaaaaaaaaaaaaaaaaaaaaaaaaaaaaaaaaaaaaaaaaaaaagagaaagaaaaaaaagaaaaaaaataaagaaaaaaagagaagagaaaaaaaaaaaagagaagaaagggaaaaaggagagagaggaggggagcggcaggacggagagcacgaaacaaaaacaaaagaaacgtcgccagcgcaagaaacgcaccgaaagaaaataccaaacacataccgcaagacatgggagtcggcgaaaaaacagacgacagaagcaagagaagcacgaggctgcgacaggacgcaaaaaagaggaacagaagcacacgaagaggaagatccacaagacagcagggagacaagacaaaagcaacgccgaccggagaaaagaaacaagcaagcgcagcgacaagacgccgacaaaagacgaagatcggaaagggagagcagagaaacaaaacaacaaagaagaatactgcgaacacgacagcgatgctcgaatatacaagatactaacaacagaagacgcagacgaaagagtaagcaaaacaagacaaaagtgacgagtggaggacgaggagcgagagagagcagacgaggaggaccgacagctggagacgaggacaggagagccagacgcaaagcaccaaacgaacagaagctcgtagcacgaagataactttgagatactgagagcgaactgacgagggacggagcaaacagagagcatagacagagaacaggcacacagcgacacacagggcaagaatagctgaggataagcaagcagacaacgagccgatccagcggagggagcacgacagacagaagggatagacagagagt

SEQ ID NO: 64147 - DNA, 4886 bp, Homo sapiens
aagcacaagctgggacgcaatgtgtgtccctctatccctacattgactttgcgggggtggggatggggtgcggggtgagtgagggaggactgcaagtgacaaacaggattcgtcaaaagagaggtgtattaaagtgccgatcaaatgtaatttaacagctaaactttccctccttggaaaacaggtgattgttgagtatttaacgtgaatcgatgtaaacctgtgtttggtgcttagacagggggcccccgggtagagtggaaccccttaagctaagcgaacaggagcctaacaaagcaaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccacaaaaaaaaaaaaaaaaaaaaaaaaaaaaaaaaaaaaaaaaaaaaaaaaaaaaaaaagagaaagaaaaaaaagaaaaaaaataaagaaaaaaagagaagagaaaaaaaaaaaagagaagaaagggaaaaaggagagagaggaggggagcggcaggacggagagcacgaaacaaaaacaaaagaaacgtcgccagcgcaagaaacgcaccgaaagaaaataccaaacacataccgcaagacatgggagtcggcgaaaaaacagacgacagaagcaagagaagcacgaggctgcgacaggacgcaaaaaagaggaacagaagcacacgaagaggaagatccacaagacagcagggagacaagacaaaagcaacgccgaccggagaaaagaaacaagcaagcgcagcgacaagacgccgacaaaagacgaagatcggaaagggagagcagagaaacaaaacaacaaagaagaatactgcgaacacgacagcgatgctcgaatatacaagatactaacaacagaagacgcagacgaaagagtaagcaaaacaagacaaaagtgacgagtggaggacgaggagcgagagagagcagacgaggaggaccgacagctggagacgaggacaggagagccagacgcaaagcaccaaacgaacagaagctcgtagcacgaagataactttgagatactgagagcgaactgacgagggacggagcaaacagagagcatagacagagaacaggcacacagcgacacacagggcaagaatagctgaggataagcaagcagacaacgagccgatccagcggagggagcacgacagacagaagggatagacagagagt

SEQ ID NO: 64148 - DNA, 4175 bp, Homo sapiens
agatctctgagggctggaagtgctaaggacaatttcataaagaagaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccacaaaaaaaaaaaaaaaaaaaaaaaaaaaaaaaaaaaaaaaaaaaaaaaaaaaaaaaagagaaagaaaaaaaagaaaaaaaataaagaaaaaaagagaagagaaaaaaaaaaaagagaagaaagggaaaaaggagagagaggaggggagcggcaggacggagagcacgaaacaaaaacaaaagaaacgtcgccagcgcaagaaacgcaccgaaagaaaataccaaacacataccgcaagacatgggagtcggcgaaaaaacagacgacagaagcaagagaagcacgaggctgcgacaggacgcaaaaaagaggaacagaagcacacgaagaggaagatccacaagacagcagggagacaagacaaaagcaacgccgaccggagaaaagaaacaagcaagcgcagcgacaagacgccgacaaaagacgaagatcggaaagggagagcagagaaacaaaacaacaaagaagaatactgcgaacacgacagcgatgctcgaatatacaagatactaacaacagaagacgcagacgaaagagtaagcaaaacaagacaaaagtgacgagtggaggacgaggagcgagagagagcagacgaggaggaccgacagctggagacgaggacaggagagccagacgcaaagcaccaaacgaacagaagctcgtagcacgaagataactttgagatactgagagcgaactgacgagggacggagcaaacagagagcatagacagagaacaggcacacagcgacacacagggcaagaatagctgaggataagcaagcagacaacgagccgatccagcggagggagcacgacagacagaagggatagacagagagt

SEQ ID NO: 64149 - DNA, 447 bp, Homo sapiens
actgataatctatgagtgcttctgcagtcatgaggggctttgggtctctgcaaaactcttttctcaggtttaatataattgtgggtaccgatttttcagtgctgtaagctcctgggtccactgaaggcaacctggtggctcaaagaaacttgatgattgaatcagtggtattgttcttctcaaatgataatataggtcttaaaaattccaatgtgacataggtaattttataaaatacattaaaaatgagtcactgaggttgagaaaatttcagcctgttcctgaagatcatggagcattgttggtagcactgataaatggcaaagttaggaccttagcccagattatttgctcctaagctcattgggtttacacttttgcttttctttagattcataactattgcatcaaagacagttatcgtacactcctctaatcttaggaaaa

SEQ ID NO: 64150 - DNA, 301 bp, Homo sapiens
aggtttctctcaagagctctactcatggaaggctctattctgataaactctccgtctcccctgccattacaacgttgaaatgaaaatcccctgagctaaaagtaaaacaaaacagtgtctaaggataacttagaaattactcatactgctaaaggtattttaacagatttaagaattaatatttcctgtttttatatagtttttgcattgggcataatgcagtacagtatgcaaagattagtatatttacaattgctttcactacttttcttagaggcaataaaaatgcacctgtgaattt

SEQ ID NO: 64151 - DNA, 409 bp, Homo sapiens
cgtctctactaaaaatacaaaaattagctgggcatggtggtgcatggtagcatggtggtcccagctattcaggatgctgaggcaggagaatcgcttgaacccaggaggtggaggttgtggtgagctgagatcacgccactgcactccagcctgggtcacagggtgagactccatctcaaaaaaaaaaaaaaaaaaatacaatatttgcaaactggtcattatttaaataagttctaagttgtattcaaattatttaatttcgtgagtcttagattcactaagtacctgactttcagtggtattatgtagtctaagaagtcgacgtagagcagctgcaatcctctgagcatcacacattgttaaaagtcagaaggtgactctttaaatattgtgaataccagcctaaatc

SEQ ID NO: 64152 - DNA, 155 bp, Homo sapiens
tcataacagggaagtgaaagttgtcaactatgcaaaagcaaaattaaataaaatatcagagttaaaaagattttaccatatagatttaaaatacagtcttagaatctattcaagaacttcacatcaatgagaaaatgtctctgtaaataaatcca

SEQ ID NO: 64153 - DNA, 377 bp, Homo sapiens
aactctcctaattcttttccttagctagctaccttgcaagctattatataaaagataacagctatttcctaagttaccctctaactaaaataccatgtaccccacaccaaccagaatggcaagaatcttaaggacaaaataccatgatgctttagcaagtggaatattcatacattgctggtgagaaggtaaactggtacaagcattctggaagactgttttgcagggatctactgaagctgaaatacacatggcctacaaatgagcaattccactcccaggcataaacataacagaaatacaaaaacatgtacaccacagaagcactattcataacagtcaaaaactgaaaaccacccaaacaagcaacaaaagta

SEQ ID NO: 64154 - DNA, 245 bp, Homo sapiens
aggaaactcattcaggcaagttcagccctttatgaggaattcccctgtggtcacattccaattcctggacctgctgccaccctcagaactgcatgctccttcttcagactttctaagaatgactcaggtcattggtggagtgaagtcaagatttccaactcagtcacctgaagagatggagataccattcatggagctggaggtccctggagatttgggaattcagataacaagctaagataagg

SEQ ID NO: 64155 - DNA, 1910 bp, Homo sapiens
attgtcatgctggtgggcgtcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacaatttccaaaatggtctctaacatttccttacagaactacttcttacttctttgccctgccctctcccaagtaactgggattacaggcatgtgtcaccatgcccagctaatttttttgtatttttagtagagatgggggtttcaccatattggccagtctggtctcgaactctgaccttgtgatccatcgatcagcctctcgagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaccatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaact

SEQ ID NO: 64156 - DNA, 1994 bp, Homo sapiens
attgtcatgctggtgggcgtcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccggtgagagaccttttgttcttttgatcactctcaatttttatgtggcctaaaatacagactccatgaattgattttgtcgttaagggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacaatttccaaaatggtctctaacatttccttacagaactacttcttacttctttgccctgccctctcccaagtaactgggattacaggcatgtgtcaccatgcccagctaatttttttgtatttttagtagagatgggggtttcaccatattggccagtctggtctcgaactctgaccttgtgatccatcgatcagcctctcgagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaccatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaact

SEQ ID NO: 64157 - DNA, 2100 bp, Homo sapiens
attgtcatgctggtgggcgtcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacaatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctaagcctcccaagtaactgggattacaggcatgtgtcaccatgcccagctaatttttttgtatttttagtagagatgggggtttcaccatattggccagtctggtctcgaactctgaccttgtgatccatcgatcagcctctcgagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaccatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaact

SEQ ID NO: 64158 - DNA, 1590 bp, Homo sapiens
cgtggatgttcagagggaacaatgacagagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacaatttccaaaatggtctctaacatttccttacagaactacttcttacttctttgccctgccctctcccaagtaactgggattacaggcatgtgtcaccatgcccagctaatttttttgtatttttagtagagatgggggtttcaccatattggccagtctggtctcgaactctgaccttgtgatccatcgatcagcctctcgagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaccatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaact

SEQ ID NO: 64159 - DNA, 1804 bp, Homo sapiens
caagggccccggcgccgggggcggcggggaaccccaaacgcaaccgggtctggagggatccccgcgccgagccagccgccgtcaccgcctccgcgccgcccctgcgggcttggcaggcgcccggcgcgcccgcactgcgcccggccgccggctcccgcggtcccaccgtgagctcgccggcccgtcgcccgctcgccatgcaaccgccgccggcctcgcgcgcgtaggccccgccgcaggccatgctgcccctgctcgccgcgctcctggccgccgcctgcccgctgccgcccgtccgcggcggggccgcgacgcgcccggcctcctcggggtgccctccaatgcttcagtcaacgcgtcctccgcggacgagcccatcgccccgcggctgctggcctcggcggcccccgggccccccgagcgcccgggcccggaggagacggcggcggcagcggcgccgtgcaacatcagcgtgcagcggacagatgctgagctcgctgctcgtgcgctggggccgcccgcggggcttccagtgcgacctactgctcttctccaccaacgcgcacggccgcgctttcttcgccgccgccttccaccgcgtcgggccgccgctgctcatcgagcacctggggctggcggcgggcggcgcgcacagggacctgcgcctctgcgtgggctgcggctgggtgcgcggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggggactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctcca

SEQ ID NO: 64160 - DNA, 209 bp, Homo sapiens
gcggccgcctactactactactactgctcgaattcaagcttgtaacgatgtacggggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctcca

SEQ ID NO: 64161 - DNA, 2434 bp, Homo sapiens
caagggccccggcgccgggggcggcggggaaccccaaacgcaaccgggtctggagggatccccgcgccgagccagccgccgtcaccgcctccgcgccgcccctgcgggcttggcaggcgcccggcgcgcccgcactgcgcccggccgccggctcccgcggtcccaccgtgagctcgccggcccgtcgcccgctcgccatgcaaccgccgccggcctcgcgcgcgtaggccccgccgcaggccatgctgcccctgctcgccgcgctcctggccgccgcctgcccgctgccgcccgtccgcggcggggccgcgacgcgcccggcctcctcggggtgccctccaatgcttcagtcaacgcgtcctccgcggacgagcccatcgccccgcggctgctggcctcggcggcccccgggccccccgagcgcccgggcccggaggagacggcggcggcagcggcgccgtgcaacatcagcgtgcagcggacagatgctgagctcgctgctcgtgcgctggggccgcccgcggggcttccagtgcgacctactgctcttctccaccaacgcgcacggccgcgctttcttcgccgccgccttccaccgcgtcgggccgccgctgctcatcgagcacctggggctggcggcgggcggcgcgcacagggacctgcgcctctgcgtgggctgcggctgggtgcgcggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggggactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctccaaaaaaaaaaaaaaaaaaaaaaaaaaaaaagaaaaaaaaagaaacaaaaaaaaaaaaaaaaaaaaaaggggggcggggacgaaaaaagaaatcacccacgggggggggcgccacaaacagtattagggcaaataacaacagcggtgtcgtgggaaaaaaggggggggcccaaaaaaagggggggagcagacaaaacacacagcaaagagaaaaggaggaggcggacgggaacaacaaaacggtccgatgtcccggggaacaacactcctatacacgagagccgagacccctttgtgagaagaagcacccccaccaagactggggacggagagaggacacaaattgtgggggggacaccacaaacctgcagtaagaaaggatttacagaagcgctcccttgagcggcaaactaagaataagacgttaccacaagggtgaattaacgatggtggggaaaacccaaagcgcgcgacatcaattagatgcgcagacgagtagacgaaaagactgctcgttccacacacactgaggatttactcattttcagaacagcaatattttattcaaccgagaggccgtagtgaataatacaagtagagaactaagtaagctagtacaaagcgacgaccgc

SEQ ID NO: 64162 - DNA, 377 bp, Homo sapiens
atgtgttaaaggatacaggtaaataggagaaataagttctagtgttctatgccactgtaggataactatagtttacaataatatatgatacagtttcaaatagctagaaggaagatattgaatgttcccaagacaaagaaacgataaatatttgagatgattgatatgctaattattctgatctgatacattatatgtataaaaataccactgtatcccctgaaaaagaacgattattgtcagtttaaaaacaaaaatataagggtttaaaaaaaatggcctaaatgaaaaagacagacaatactaagtgctgatgaggatacagagctactggatcttttataggaacataaattggtgcagccactctggaagag

SEQ ID NO: 64163 - DNA, 436 bp, Homo sapiens
acagtaaatttgctcacacaccaagcacattgctactgtaactagcatctgaggaagccatcacataaagagtctctataaccaaggagctcatacagaatcttcacccctgaaagcactcagagccaaattaggttatgataacttataaacattaaagtcacatcctcaaggggaaaaaaagaaacaaacaacaacaaaaaacacagtcaaataaaaagtgagccagaaataaattaaaaaataattagaagaaatagactacccaaaagagaagaaaacagaaaaataattctggcaatgtgacagaacagcattctacaacaacttcaaaagatcacagccactctccagaaatggatccaaaccaagatgaaatctttgaaataccaccagcctggccaacatggtgagactccatttctactaaaaatcc

SEQ ID NO: 64164 - DNA, 365 bp, Homo sapiens
attagaccactttaagtataatgtaagaaccttacaatatacttacattgagcttacttgcagtgagccaagatcatgccactgcactgcagcctgggtgacaaagtgagactctttctcaaaaataaattaaaaattaaaaaaataaaatagatagaaagatagagtgagactctgcatctaaaatagatagacagattgaccaaccaacctacctgtcactttgcatgactctttagtttcaaaaggatgatcatctaaacaggggtgtccaatcttttgcttcccttgccacactgcagaagaattgtcttggccacacataaaatacaccaacactaatgatggctgatgagctaaaaaca

SEQ ID NO: 64165 - DNA, 393 bp, Homo sapiens
atccaccattacagtattatacagagtagttttactgtccccgaaatcatctatgctccaccccttcacatccacccctcagcccctggcaaccactgatcttttcactgtttccataattttgtcttttccagaatgtcatctagttgaaatcacacagcatgtaaccttttcatattggctccgttcagatagtaatatgcatttaagtttcttccatgtcttttcatggcttagtaactcatttctttcttgtactgaatgatattctattgtctgcatgtaccacagattctttgtttgtttgttcttttacttatcagtttatatgctgaaggacacatcttggttacttccaagctttggcaattatgaataaagctaataaacatc

SEQ ID NO: 64166 - DNA, 3660 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64167 - DNA, 1406 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacac

SEQ ID NO: 64168 - DNA, 2292 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaata

SEQ ID NO: 64169 - DNA, 369 bp, Homo sapiens
  misc_feature (154)..(154): n is a, c, g, or t
atagaatttttgaaaacttgctaatcaccttttgatgaaatattagtagatggtttaaagcgggacatcaactacataatgaaagatgcttgaaatgcttttgttaattcaggcaaatcaaaataaatcggactatcaaactacaagaggcccnaacctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64170 - DNA, 549 bp, Homo sapiens
agtgcggcgtgtgcacgcttgatgccgtgtggctgtctctagagtatcccgcggcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgccgtggagccgctctatttgaatctttctaattgaaacggctagggaagagaccacccagagagctccctccatggacagggctctgggctctgcccccgctctgccctgcagagct

SEQ ID NO: 64171 - DNA, 3122 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccacccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64172 - DNA, 3402 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64173 - DNA, 2376 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaata

SEQ ID NO: 64174 - DNA, 3832 bp, Homo sapiens
ccctgaatagccactaagggatgcttcagccctgtgcagtgcttccctcacgtttcaaaaaggccagtattttggaaagataaccttttttcaatatagtctgcatattatcagaaagcatgggtgagtacctgcaaggagtaccatgtggacccctgcgaggggtaccgtgggggcccctgcgaggggtactgtgtggacccctgtgaggagtatcatgggggcccctgcgaggggtaccgtgcgggcccccgcgaggagtatcgaggagtaccgtgtggacccctgccttctgcagtgagatctcgggacgtttgcgggagactccgctgcagccaccgcggtgccgtcagagaggcctccttggtagaggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64175 - DNA, 3510 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64176 - DNA, 3111 bp, Homo sapiens
ttctagaggataccgccgagatcacatacatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64177 - DNA, 1863 bp, Homo sapiens
tacggtccggaagtcctttggatgtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64178 - DNA, 1253 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacac

SEQ ID NO: 64179 - DNA, 977 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacagggtacagaggcaaagtaagagccaagaatatacgggcatagacccgcatagaggaccccgaacaagccagacgaacacctagagactacacaaggaaaacaagacagcccacgggcacacgaatgggcggccgaagaaataccccgctaggaaaaagagtacaaccacaatcaacaggagccccccagggcgtggactactatttctattctgcgagaatactaacgaaagagagaggccttgctccaagggaccaaccacagaaacccgagaaacgccacaaacaccaacgccaaaagacccaagaaagccggaatcaaatagatgagagacaataaggaatcgaggcagaaccgggagttcagtatggagtgacgatatggatattggaaaggcgatgctgcggctaaaagcgcgaaccgcgacctaaggacccggtcggaaccgggaaggaaagaagccgaggccgcaagccgcatggagggccggaaaaagaccgaagcgggagaaaaccggggcgtaaggtgggagagtaagagaacgccgagaaccggtgataaacgcgccattggggcggagaatcctcccaatcgtgaagtgggccggggagacccgaatgcgcgccga

SEQ ID NO: 64180 - DNA, 3629 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64181 - DNA, 2397 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtctctgtttcttctgactaccttaactctttttcttactttacctctct

SEQ ID NO: 64182 - DNA, 3576 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64183 - DNA, 3236 bp, Homo sapiens
taaggctagtagaggctcgggttaatctggccgaggcccgtggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 64184 - DNA, 1148 bp, Homo sapiens
tgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttctggaaaatgctcttgctgtagagagcagctgcttctgccagggtgttggaggtggtggagcgccttccgattccattcatggcattttgtgatgtgatgtaattggaatagagctgttgatttaaggcacacac

SEQ ID NO: 64185 - DNA, 481 bp, Homo sapiens
ttctctttttgtcttttcagaacaaactatcctcaccactgtatagctagagacctagctgttctaaattaaaaggtgtcatttaaagaagcagtttttattttcttaatgccctaataatagttgaataataaaaggagtctagatcaaaatgttttataaaaaaattgaagttttacattttttactcaactgttttaccaccagcagttgataatttaattattattttgacacatgtggtttttggcaagtggttaccataaataactttccagttttctaaatttgaatttaaacattatgtataaaaatatatatgtttacatttttattgtttgtatgtctgtgaattgttatctaagagtatggaaaagaagagcatgactagagtgaataatttaaccatttctgtagcttctaatttgcgtatgaattaaaatgtcttatttcttcaagtaaaaaaatgttaagaaaatga

SEQ ID NO: 64186 - DNA, 4183 bp, Homo sapiens
  misc_feature (753)..(753): n is a, c, g, or t
  misc_feature (1720)..(1720): n is a, c, g, or t
  misc_feature (2738)..(2738): n is a, c, g, or t
  misc_feature (2992)..(2992): n is a, c, g, or t
  misc_feature (3624)..(3624): n is a, c, g, or t
tccctgatatgatgtctgcaggtattcatgctcctgtatagttccctcccacactgaatagggttgccctgttgaaacgttggaatattctggaaatgaccatgtgtgacttccaaggcaaggtcataataaaaaacattgcagctcctaccttgtctctcagatcactagttcaggggaagccagctgccatgtcataaggatgctcaagcagtcctacagaaagttccatgtgaccaggagcagaggcctcctgccggcaaccagcactagtggcaggcatgtgagtgcgccatcttgcaagcagctcttccagccccagttgagccttcagatgactgcagccccagctgacatcttaactacaacctcatgacagaccttgagcagaccctctggctaagcttctcccaaatttatgactcccagaaacagtgcaagatgatacatatttattgttgttttaagctgctaagttttgaggaaatttgttacacagtgagaggtactcaatacactgagtcactcccctaacccatagcacaggctgagtccccaaacctgcactagaggcaacaaagagggagaagccctttccatggagctaactgtgcatctggggagaaagagtcatcctaagtccatctggggaccatgagggttggtgtgggatctggtgggggtggtctagggcctagagcaagtagccctggtataggacaccaggaaaacaactcagggcaggatacaggnagtccttgggcagggtcctagagctcctggggggcttggaaacactagggtgattaaaagagaaagcactgcaggtcaaggaagcaacacaatagtctgtgagccctctcagtaatataaccacgacacaactctattactgatactactaaccataatgacaatcagaagagctacctgccctctgaagcatgatgaacaagtacttctgcattgtctcttgcactcttatgtaaaacccagtgtacacgtgcttttattatatccattttacagatgagaaaactgagactctgggatgttaagaaagtggcttgccaaaacccacccagctaataagtgcagggccaggatttgaatctgaatagtctgactccacaggctctatacaagtggcctagaaagcagtgtgggtcctccatggggcctcctgttgcgcaccacagaagccctggctctgaggcccaccttatcccaaccccggagttagttgagtggctggagccatggctgcccagaggcctaaggctgcctcagcacccttctggcctgctcccttcctccttggctccctggctcctgcacctgctggatattctccttttcctaactctgggggcctctcaggctcactgtaggtgctgcaaggcaaggccctttctgtatgcccctgggcctgtccttctgcctgtgacccttaacctgaagcacaaaaggtctgcgtgggaatggaagcagggcatcagctgagggagctgtgtatatggtcagcccaacctggccttgtagtgaggagtttcaaagcttgaagcctccttctttgggagattctgcaaaggtgccaaccccttgcaaaggagccctggcatcagaaccctccccaggggtgtcccagggagtgggggtgccctgggccctgcagcccatactccttgagggcagcaggctatggggcaccctgggcatngctttgggaggcctgcaaaggatttctgtgctgggggcaggagataccccatggcgcggcagagcatccacaaagtccccacccatgacagggtctcctaggttgagagtgggctggggagtgggttgggcagccagggtgccaatgcaaagaggccccaccgaggtatgagacacaagcatcccgggcatgtcctgctgtactccctgtgagacctggggaacagcgccatgcctccctgtgcataaggtggcaggaagaagaatcgaccgtctgaccctagtgattggggaggagggcagggccagcacctcaccccacacaagcacaggaagaggggcggccccaccagccccggctgagctgaccccccgccctgtcagagggaggcactggtcttaaagccacctgcttcctccaccccaccttccatttcccagagaggccagaggcagaggggtgcagaagagagagcagagcccctttgcctgggcacatctgggctcactacatgggaaagggccccaggacaagggaagacgagaagagacaggccaggcccaaggagggagaggacctgagatcgaagataggagagaggaagacaagaaggagaagcagaaatgagaaggttggagaaatccgaagaggcagctagggagagtgggaggtaggcagagggcaggcaggagaaaagaaatgattctttttgaacaggcccgcggctcctccagcacactgactcaaagatgtgggcagctgagcctgcctgctctgtgccgtggctttctcagttagtccaggaccactgggaggggagtggtggacacccagctagcgcctcccccatcaggagcacctacagtctgtgatgactgcccccagcaccctaagtcaatgtttaaccgtggcctgagcccaggaatgttctatctgggacatgcaattacagggggttgggttacagtcccaccactggcaagggcttggtggcaggagataagaaggtggcaccagnaagggttgtgtgtgtgctcaaccgtgggctcccagcacacccccggggccggctcacaaggctccattgttggggtctggctcccagcccatcgccagccagataggagctgctgttttgacaaggcgagaaaagcacaccccaagttcgtacagatcccgtaccccattcttatcaggtggaaggtagggagctagcaaagctaatgttgatttagagaaaaaaaaaaggaagaaatattagcaatcatgggnaaagtcagttccggcagctgaaggcagggttgggagtgtcaagggctggggaagaggccccacggttctggtgctatgctgggtactatggtgcgggagtggaaaccaggcatagccattctgcttcctaggacttgaagtctagttaggacaagaatagttcatttattcacctaaatatgcaggctctgtcgtaggtgctggggggattcaagttgctgaacttctagtggaatgtgcttaaaaatagagagctgtgaacatctgcacttagctggggggacagggcgagtgagacagagggaaggcggggatcactcttgggtagacaggcaaggccctgaaggctgaaggagaaatgcagattattaccaggaggctgggtgtgaatcccagctccttctccaccagcggattctgagagaggaattttgtctgactgagccgcaatctataaaatgaggaagacaggagaaactacttaaggtggttaaatagaggattggaggagagaagtcatgcaggtactgagcacaggtggcccctctggaaatcagtatcacaaatgggtaaatcacaggcagctggtcatccaagctgggagctaaagtgtggtaaacgtgggctagacnccaagctggtgctgtaggctaggattgggctagttagcacagagcagggacggcagctctgggagagaaaggaggccagcctgctgtgagggtagggtcacgtcccctctttccccagcatgaggggccggcacaccacagacatagagggcagctgccatcaccactcaaaaactctgcggcaccagtttaaagtgtgctgtaaaatacagatttggaagaaatgagctgagtagatcactttaaggatgaaaaatccctataaaatgtcagtttgggccggacaaggtggctcacacctataatcccagcactttgggaggccgaggtgagtggatcacctgaggtcaggaattcaagaccagcctggccaacatggcgaaaccctatctctcctaaaaatacaaaaattagccgggcatggtggcaggtgcctgtaatcccaactactcaggaggctgcgacaggaaaattgcttgaactcaggaggcggaagtttctgtaaaccaagattgcactactgcactccagcctgggtgacagagtgagactcagtctc

SEQ ID NO: 64187 - DNA, 3030 bp, Homo sapiens
  misc_feature (753)..(753): n is a, c, g, or t
  misc_feature (1720)..(1720): n is a, c, g, or t
tccctgatatgatgtctgcaggtattcatgctcctgtatagttccctcccacactgaatagggttgccctgttgaaacgttggaatattctggaaatgaccatgtgtgacttccaaggcaaggtcataataaaaaacattgcagctcctaccttgtctctcagatcactagttcaggggaagccagctgccatgtcataaggatgctcaagcagtcctacagaaagttccatgtgaccaggagcagaggcctcctgccggcaaccagcactagtggcaggcatgtgagtgcgccatcttgcaagcagctcttccagccccagttgagccttcagatgactgcagccccagctgacatcttaactacaacctcatgacagaccttgagcagaccctctggctaagcttctcccaaatttatgactcccagaaacagtgcaagatgatacatatttattgttgttttaagctgctaagttttgaggaaatttgttacacagtgagaggtactcaatacactgagtcactcccctaacccatagcacaggctgagtccccaaacctgcactagaggcaacaaagagggagaagccctttccatggagctaactgtgcatctggggagaaagagtcatcctaagtccatctggggaccatgagggttggtgtgggatctggtgggggtggtctagggcctagagcaagtagccctggtataggacaccaggaaaacaactcagggcaggatacaggnagtccttgggcagggtcctagagctcctggggggcttggaaacactagggtgattaaaagagaaagcactgcaggtcaaggaagcaacacaatagtctgtgagccctctcagtaatataaccacgacacaactctattactgatactactaaccataatgacaatcagaagagctacctgccctctgaagcatgatgaacaagtacttctgcattgtctcttgcactcttatgtaaaacccagtgtacacgtgcttttattatatccattttacagatgagaaaactgagactctgggatgttaagaaagtggcttgccaaaacccacccagctaataagtgcagggccaggatttgaatctgaatagtctgactccacaggctctatacaagtggcctagaaagcagtgtgggtcctccatggggcctcctgttgcgcaccacagaagccctggctctgaggcccaccttatcccaaccccggagttagttgagtggctggagccatggctgcccagaggcctaaggctgcctcagcacccttctggcctgctcccttcctccttggctccctggctcctgcacctgctggatattctccttttcctaactctgggggcctctcaggctcactgtaggtgctgcaaggcaaggccctttctgtatgcccctgggcctgtccttctgcctgtgacccttaacctgaagcacaaaaggtctgcgtgggaatggaagcagggcatcagctgagggagctgtgtatatggtcagcccaacctggccttgtagtgaggagtttcaaagcttgaagcctccttctttgggagattctgcaaaggtgccaaccccttgcaaaggagccctggcatcagaaccctccccaggggtgtcccagggagtgggggtgccctgggccctgcagcccatactccttgagggcagcaggctatggggcaccctgggcatngctttgggaggcctgcaaaggatttctgtgctgggggcaggagataccccatggcgcggcagagcatccacaaagtccccacccatgacagggtctcctaggttgagagtgggctggggagtgggttgggcagccagggtgccaatgcaaagaggccccaccgaggtatgagacacaagcatcccgggcatgtcctgctgtactccctgtgagacctggggaacagcgccatgcctccctgtgcataaggtggcaggaagaagaatcgaccgtctgaccctagtgattggggaggagggcagggccagcacctcaccccacacaagcacaggaagaggggcggccccaccagccccggctgagctgaccccccgccctgtcagagggaggcactggtcttaaagccacctgcttcctccaccccaccttccatttcccagagaggccagaggcagaggggtgcagaagagagagcagagcccctttgcctgggcacatctgggctcactacatgggaaagggccccaggacaagggaagacgagaagagacaggccaggcccaaggagggagaggacctgagatcgaagataggagagaggaagacaagaaggagaagcagaaatgagaagttctgggggctgagaagtccaagatcaaggtgctgccaatttggttcctggtgaatgagcaaacagcacagaaaaagaaacagcagtatatgtggaagaaagcaagaaaaatcaactggcctggaacctaagacttgtccaaagatgtcacagagagtaaaatgagaaaaatccagtagcccgtgcccagagcagttcctcgtacccagtgagagatgaatgatgctcttcccaaggaaggcagaggaggcgacagtccatttgcgttctctcctctgcaagtacaggatctcgtttgattctcaaaaccaccctagaggagacaggaggcacctgaggcccagagacgtgaagccacctgtccaaggccatacagcagatgacttattctggaggaagacacctgccatgccgtgaggacattcaagcagttctgtggagagatccatgtggtgagaaacaggggcctcctgtcaacaggaagaacaacctggcaggcctgtcttggattcagagcctccagccccagtcgagccttcagataactgcacccttggctgtcatctcaactgcaatctcacgacagaccctgagctggaactactctgtttaccaatgcctggcccacagaaagactatgagataaaacaagtatattgtttttagaagatatgttttg

SEQ ID NO: 64188 - DNA, 551 bp, Homo sapiens
ggaggcccagtgggagtcccctgggcccctcaggtttccctcttgacgcaagatgggagattgagaggtgctaggcatgttccccaagagctgttgtaatttattttgtcattcattagtaagcccccttgccatagcaaagattcctaggagctgggctcatggcttatgcctgtaatgctaatactttgggagtctgaggcaagaggatcgtttgagcctaggagttcaagaccagcctgggcaacatgatgacttattctggaggaagacacctgccatgccgtgaggacattcaagcagttctgtggagagatccatgtggtgagaaacaggggcctcctgtcaacaggaagaacaacctggcaggcctgtcttggattcagagcctccagccccagtcgagccttcagataactgcacccttggctgtcatctcaactgcaatctcacgacagaccctgagctggaactactctgtttaccaatgcctggcccacagaaagactatgagataaaacaagtatattgtttttagaagatatgttttg

SEQ ID NO: 64189 - DNA, 399 bp, Homo sapiens
acccttgacccatcactgtgtttctgtaggcagaaggctaacaagccctgcacctgaggcccagagacgtgaagccacctgtccaaggccatacagcagatgacttattctggaggaagacacctgccatgccgtgaggacattcaagcagttctgtggagagatccatgtggtgagaaacaggggcctcctgtcaacaggaagaacaacctggcaggcctgtcttggattcagagcctccagccccagtcgagccttcagataactgcacccttggctgtcatctcaactgcaatctcacgacagaccctgagctggaactactctgtttaccaatgcctggcccacagaaagactatgagataaaacaagtatattgtttttagaagatatgttttg

SEQ ID NO: 64190 - DNA, 778 bp, Homo sapiens
cgcggccgcgcgactacggctgcgagaagtccgacaagaaggagaagcagaaatgagaaggttggagaaatccgaagaggcagctagggagagtgggagttctgggggctgagaagtccaagatcaaggtgctgccaatttggttcctggtgaatgagcaaacagcacagaaaaagaaacagcagtatatgtggaagaaagcaagaaaaatcaactggcctggaacctaagacttgtccaaagatgtcacagagagtaaaatgagaaaaatccagtagcccgtgcccagagcagttcctcgtacccagtgagagatgaatgatgctcttcccaaggaaggcagaggaggcgacagtccatttgcgttctctcctctgcaagtacaggatctcgtttgattctcaaaaccaccctagaggagacaggaggcacctgaggcccagagacgtgaagccacctgtccaaggccatacagcagatgacttattctggaggaagacacctgccatgccgtgaggacattcaagcagttctgtggagagatccatgtggtgagaaacaggggcctcctgtcaacaggaagaacaacctggcaggcctgtcttggattcagagcctccagccccagtcgagccttcagataactgcacccttggctgtcatctcaactgcaatctcacgacagaccctgagctggaactactctgtttaccaatgcctggcccacagaaagactatgagataaaacaagtatattgtttttagaagatatgttttg

SEQ ID NO: 64191 - DNA, 224 bp, Homo sapiens
agtagtcgggtgcaggccccaccaacgggggacgtcacggcactgggacggctgggacgcttccgcgttagtctcccatggaggccctgggcggctcgagccagtcttcaggccgaatctcccgcctccaggattgcatccgaggcctggcagccggtgacacttccgaagggcttgaattactcgggcgccagccctgtcgtattaaacgcagtgcttccgct

SEQ ID NO: 64192 - DNA, 365 bp, Homo sapiens
cttcagaatgcagcaaagcatgagagagtattagaaggccgctgagaaagacaaacaagttttagtattacagaagtattcaacaaccaaccattgaaggtgcaagaactgggccatcccatgggtccaccagggctttgacaaggcaggtgctggggcagagcactctggccaggaagcaaaagatgaaggttcccatcttggccccagcctggatctgtgcccagtgatagtcatcagcctggatctgtgcccattgcattgtgtggacataccacgccatgtttctccatcaccttttgaggaaacttctgttgtttccaccttctaaccgtcatcagtaaagctgctgtgaaccttcgcat

SEQ ID NO: 64193 - DNA, 533 bp, Homo sapiens
cactggactgtgtcactgcatggaggctgttgccggaggaggaagtgcaggccccaaggcctatgtgcctggaaaccagctggggctgctgcaggaggagggctgcaggatgctccagctcagacctgactcagggttttagagggcacagggcataaagctgtggacatagacagccctactgcgcaggaagagcataaaccagccagagggcatgcatgggggctgctgttgcattctggtctcctttgaggtagggaaagatgtgtttctttctattttatgggtgagcaaactgaggcagagtggtggagtgatttcccccagcatcgatggcagatttagctccagggcttagattttaggatcctccctctcaaataccatgatgtatcatgggctttttctccacagaaaattagaaactcagaaatggaaaggaacaatgaaacttacccattctcccactgctcacatttccttctggtctttttgtgtgtgcatataaaatatatctcagaaaattgagtttg

SEQ ID NO: 64194 - DNA, 536 bp, Homo sapiens
aggtttattgaaaatgttacaacatttcagaaagattcaaacagctccatgtggtggatagtccaatctgcaggtcactcagcctacagttgggatgaatttcccaaagtccaaaccttcagcatttctccagtatcaagatctacttcagtgatctcctgatccaagcctgagacctcaggagcataattatctctcctttctctcttcttctcctgcaacctgatggaaatacctcttactgggcccctgtgaatctgcttcttcagatgcgtgactcagcctgctatcttgttgcagagcttcttgctggggataatgacagtcttcacccacttgcttgttcatgtggaaatcattaccggggtgcatgtaatacttttctatgatgacccaggctaccttcttcactgttttggtgtgaaggctgcccatcttggcaggtccttggtaaaagaggccaaactctttatacttaaaaatttactttgctcatcttacagccttttacatctaaatatagtttcatcaagtaa

SEQ ID NO: 64195 - DNA, 1491 bp, Homo sapiens
gtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctcgccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctgaggaggagaacacaaatcccagctcgtccggttcagcccactccgtggccaaggagccggccaaaggagccgcccccagtagacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcctgagccgaacaatcctcgaactaaaagccttcccttgcccatgtgaaaagatccgctaagacagcatgtctgccagcggaaacttctcgagctcccccctcta

SEQ ID NO: 64196 - DNA, 428 bp, Homo sapiens
gatttgatatatttgaatataacagagtatgaaaaagtttattgatatagtttcagattacacactgcaactaatctttaagaaactattacttgtccactttttggtaaaatttcagagaacaatgtccaccattatctgaacaggctattaaaatactcttctcttttccaactacgtgcctgtgcaaagtcagatttttttcatatacttcagccaaaacagcatatcaaaatggattgaatgcagaagtagatctgagaatacagccacttttgttaagccagacaatgagatttgcaaaatgtaaacaatgctgctgttctcagtttttaaaaatatgttttttaaaagtatttatgttaatgtgtacttggtttactactgctatttttaaataaaacaagaaacatttttaaaagtctgtt

SEQ ID NO: 64197 - DNA, 697 bp, Homo sapiens
tataaacttgatgaaatcagaacaggatatgtgtatttaaatgtgtaaggggagatactagaagtactaaaataacacggtaagattggaggggagaaagtggaagtacatatgaaagttatcacaagaaagctcctatgccagtgatttgcctggttgcttttatatctgctttttatgcttgtcctgccctgctctctatcacagaaattgaccccttcaaacattgttttcctctggctacttccattaccaaatatcctctggctacttccattaccaagagctcaacttgccaataccagattccaaaactgagcccacaatatgtctttgttcaaagagaggggaaaggcaaccagctaccctgtggaagattggttactttgtacttctttctcctttgaggtgagggattttccctcatgggttgaatatacacctgttctctgcaggtattttacaggtctttccatcctgcaatgctgccatcactactctactggacttacagaatgcattagaagctgtcagtatcccatatcctcctgttatgtaaatcattggtgttattacaggtctcacatctagaagtatctgtcttatcaaaattcagactatcttactgaaaccagagttacagtgtgggctaggacaacatcctgtgcagttgggtggtgccctgcaagaattatat

SEQ ID NO: 64198 - DNA, 302 bp, Homo sapiens
gaaaataaacgtcaaaagtattaatcaataagcatcgtatttaagctgaaaagtctctatgtatcagtgactaaaacattttgtccttgctgacaaaaacttcctttatggtagactgtattaaggtcactttgatcctcaccgaaactgttaatatacaagaaaaatcacagatacgtgtattcttttgagcaacaacaaaaaacattaaatggagaaatgattaaagttagacagcatcccctttaaaatatgtaggttttaaaaataacattataaagaagttctcagtattgtacact

SEQ ID NO: 64199 - DNA, 1008 bp, Homo sapiens
caagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggcttaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagtccttcggcacaggtccacaagggggaatcacccaggagtggattggagtggagggagacccacctggggcgaacattgcttctcaggaacagatgctgtgtgtgtatcttcagtgctcaagtcacaaagcaatatcagatcagagagtccagcctctgctttgttgcttcctaaatgtacctgggaattcttcctaaaattactctggaaatttgaatccactttaactaaaaataaatattcatagcac

SEQ ID NO: 64200 - DNA, 669 bp, Homo sapiens
agacagggtctcactgtgttgcccaggcttgtctcaaactcctggcctcaagcaatcttcctgtctcaactcctaaagagttaggattacaagcatgagccactgcacccaaccttcttttattttttatgtagggcaagattatggattttcaatagaatttaaatgcagtcttctcccagagtgaaaccttattgtagctttgctttatctgagatgaaaagggacaacaaattcctcccctgtttagttgagggggcccgaataattgtcaagaataatctaaatgaaggaatcttaagtggaagcggtgcacataggatattcattctccctatgggcagatactcaggtatctccagcaagatccatagttatacagctcactttgttttagaacagtggtcataatctactagtacctctgttcctatttgaggcccaattgaggatttccccaaagattcctgataaggataaggtgtatccttttcagagactgtctccctatctctccacctctgaagacttgcagaaagatttctgtttttgagtactcccaaacacaccttcacgcaattacttgtgcgtgtgaattacttgtaaccaaaaatgcatctgttcctacccagccacaaacaaaccatagtcaaagggagggcagcgtga

SEQ ID NO: 64201 - DNA, 336 bp, Homo sapiens
aatacagattttaaaaatcacacctcagtctgaaccaatatagttattttttattttaattaaattctcagctttaatttctgatatagtaatgtcaataaatgtaatccatataaattagaggaattctgagaccaaacagtttaagaattattgccttaaaaaatttctcagtctaaggccagatgtggtggctcacgcctgtaatttgggaagccaaggtgggaggattgcttggatgcaggagttcaagaccagcctgggtacatagtgagactgcctctacaaaatgattttttaaaagttagctgagtgtggtggcatatgcctgtggtc

SEQ ID NO: 64202 - DNA, 2887 bp, Homo sapiens
ctcctctatttgcagttatactttaaagtgtactcccttctctatcctatcatgaggactggacagcctccacagagatggctggacaaagcaagggaatttacttaggtaagacaccatttctctttactctgaaatccctgcaaatgtagttattccagaggagactgtgcaatgactgatgggtttagcatcctacatgaggggaaattgccattcccagctgtaaaatgaacaaatatccagttattttttttagccatcttacagcttagctaatataacaggatttacagccaattatacatgaaagtttaattctgtgtcagataaagcatatctttgatgcagaaatagaggcagcattaggccttacctggttaaaagctttttgctttctattcattcattcgttcattcattcattcaaacctatacttactgaatgctcactaaatgccgggggtttattaagagagatttaaataagatgggatctttgactattacaggtttcagcctaggggtaaattaggggaagacaaccatgtattcaaataaatgtaattaagagtaatggttgtgtgtgtattttacatgcttgtcctgtgtaaataacacgtccacggttgcacctctggggtggaacatctataaaatttagataatgatacccactttgcatggctattgtaatgaatgctcttatacatttgctatttattaaataactataatttctcatctttctgttcccactgcccttaagagtgatttgcatatttaactcaataagcatctactgaaatgagttgatctgttgatgtaagtctgctcaatatggtcttgctctcagaatatgtttcttgcctttttgatgctttagaaggctttcaaggtaagtcaagcagggaacctggtgggtagatgagggaattttcaaacacacaactgtctgatttaggatcctacatggacttggtatatagtgtcacttacttgtaaatcagatttttaaaattggaagcaactctgtgatcatctagtccatctagtctacacccttccttttacaaatgaagaatccaagagccagaagctcccagacatcctgactcaatgtcctatatttgttgtatagcctcctttgtggaagttatgtatgcatttgacttcacttaatctaagacatctattttccttgaactcttgataggtctgctggtttcctcaagggaatccaatctagctggattttaatctctttgaattgtgtcctcagctataaaagttttagctgaggttttaatggctgcacttaagtaaatctaacagatataccagggggtgttccaattacatacaccattaaagggctttatgtgaggatttttaaaaattaccattaaaaaaaaaaaagcatagtccatttgcagtataatttaccagcaggaaagatttcaatgtcctggaaaaattccctataaaaaggaagataggaaaacagaaaagtcacagtactcaacctacttcaagggaagattgggatctttttggctctctgcctctaaacaggtaaaaggctttgtattatttctagcacgagtttttcttctttagattgcatgctattgtatgtctacagggcatttgacagcccaagggctaaatccaggtgtgacggtatctaatgatgtcctgtccttcactgtccttgccatcaccagccacagagatccaggctttggggactcccacagcttatcgaccagtgtttgatttagtttttagcctctttcccatcaaatgaaaattaacttggagacacatttcattagaaaattagaggcccccttggctaggaaggcatctggtctgggactaactactttgaacagtgttgagtcctctctcccacagatggttcagccagcagtaatgctaggaagactgaaggataaatagaaaaatgtcattagtaccatggggtagccatgtaatgtcaagcaattttatattagccagagattcctagtaggagctacttttcttaacagatgactcagttctctttatctcaggaatgaaagagttgaagaccaatccacaacaggggaaatgttaaggcaaaatgatgaacttgataagggatgaattatggggtttggataaccaaacaataaaaataaaagtatagactattttagtactaaaaaggtcctgaacatgtgagcttaagtactcattttgtccccagtggctaagaaactaaaggcaagccagcaagtgtctctgagtttcagtgtctgtatgtaaaaactgactctgacttccatcttctgcagggttagtgatacagatgctagctttttcactaaagaggtcttttagtttatactcaaccttgtctggatctaatttgattgtgcattcatgtgccttagaatgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaaatccattgggccagaaggaatgaccattactaacatgacttaagtataattctgacattgaaaatttataacccattaaatacctgtaaatggtatgaatttcagaaatccttacaccaagttgcacatattccataataaagtgctgtgttgtgaatgaagt

SEQ ID NO: 64203 - DNA, 2018 bp, Homo sapiens
ctcctctatttgcagttatactttaaagtgtactcccttctctatcctatcatgaggactggacagcctccacagagatggctggacaaagcaagggaatttacttaggtaagacaccatttctctttactctgaaatccctgcaaatgtagttattccagaggagactgtgcaatgactgatgggtttagcatcctacatgaggggaaattgccattcccagctgtaaaatgaacaaatatccagttattttttttagccatcttacagcttagctaatataacaggatttacagccaattatacatgaaagtttaattctgtgtcagataaagcatatctttgatgcagaaatagaggcagcattaggccttacctggttaaaagctttttgctttctattcattcattcgttcattcattcattcaaacctatacttactgaatgctcactaaatgccgggggtttattaagagagatttaaataagatgggatctttgactattacaggtttcagcctaggggtaaattaggggaagacaaccatgtattcaaataaatgtaattaagagtaatggttgtgtgtgtattttacatgcttgtcctgtgtaaataacacgtccacggttgcacctctggggtggaacatctataaaatttagataatgatacccactttgcatggctattgtaatgaatgctcttatacatttgctatttattaaataactataatttctcatctttctgttcccactgcccttaagagtgatttgcatatttaactcaataagcatctactgaaatgagttgatctgttgatgtaagtctgctcaatatggtcttgctctcagaatatgtttcttgcctttttgatgctttagaaggctttcaaggtaagtcaagcagggaacctggtgggtagatgagggaattttcaaacacacaactgtctgatttaggatcctacatggacttggtatatagtgtcacttacttgtaaatcagatttttaaaattggaagcaactctgtgatcatctagtccatctagtctacacccttccttttacaaatgaagaatccaagagccagaagctcccagacatcctgactcaatgtcctatatttgttgtatagcctcctttgtggaagttatgtatgcatttgacttcacttaatctaagacatctattttccttgaactcttgataggtctgctggtttcctcaagggaatccaatctagctggattttaatctctttgaattgtgtcctcagctataaaagttttagctgaggttttaatggctgcacttaagtaaatctaacagatataccagggggtgttccaattacatacaccattaaagggctttatgtgaggatttttaaaaattaccattaaaaaaaaaaaagcatagtccatttgcagtataatttaccagcaggaaagatttcaatgtcctggaaaaattccctataaaaaggaagataggaaaacagaaaagtcacagtactcaacctacttcaagggaagattgggatctttttggctctctgcctctaaacagaatgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaaatccattgggccagaaggaatgaccattactaacatgacttaagtataattctgacattgaaaatttataacccattaaatacctgtaaatggtatgaatttcagaaatccttacaccaagttgcacatattccataataaagtgctgtgttgtgaatgaagt

SEQ ID NO: 64204 - DNA, 2335 bp, Homo sapiens
gatctgttgatgtaagtctgctcaactcatttcagtagatgcttattgagttaaatatgcaaatcactcttaagggcagtgggaacagaaagatgagaaattatagttatttaataaatagcaaatgtataagagcactcattacaatagccatgcaaagtgggtatcattatctaaattttatagatgttccaccccagaggtgcaaccgtggacgtgtgatttgcatatttaactcaataagcatctactgaaatgagttgatctgttgatgtaagtctgctcaatatggtcttgctctcagaatatgtttcttgcctttttgatgctttagaaggctttcaaggtaagtcaagcagggaacctggtgggtagatgagggaattttcaaacacacaactgtctgatttaggatcctacatggacttggtatatagtgtcacttacttgtaaatcagatttttaaaattggaagcaactctgtgatcatctagtccatctagtctacacccttccttttacaaatgaagaatccaagagccagaagctcccagacatcctgactcaatgtcctatatttgttgtatagcctcctttgtggaagttatgtatgcatttgacttcacttaatctaagacatctattttccttgaactcttgataggtctgctggtttcctcaagggaatccaatctagctggattttaatctctttgaattgtgtcctcagctataaaagttttagctgaggttttaatggctgcacttaagtaaatctaacagatataccagggggtgttccaattacatacaccattaaagggctttatgtgaggatttttaaaaattaccattaaaaaaaaaaaagcatagtccatttgcagtataatttaccagcaggaaagatttcaatgtcctggaaaaattccctataaaaaggaagataggaaaacagaaaagtcacagtactcaacctacttcaagggaagattgggatctttttggctctctgcctctaaacaggtaaaaggctttgtattatttctagcacgagtttttcttctttagattgcatgctattgtatgtctacagggcatttgacagcccaagggctaaatccaggtgtgacggtatctaatgatgtcctgtccttcactgtccttgccatcaccagccacagagatccaggctttggggactcccacagcttatcgaccagtgtttgatttagtttttagcctctttcccatcaaatgaaaattaacttggagacacatttcattagaaaattagaggcccccttggctaggaaggcatctggtctgggactaactactttgaacagtgttgagtcctctctcccacagatggttcagccagcagtaatgctaggaagactgaaggataaatagaaaaatgtcattagtaccatggggtagccatgtaatgtcaagcaattttatattagccagagattcctagtaggagctacttttcttaacagatgactcagttctctttatctcaggaatgaaagagttgaagaccaatccacaacaggggaaatgttaaggcaaaatgatgaacttgataagggatgaattatggggtttggataaccaaacaataaaaataaaagtatagactattttagtactaaaaaggtcctgaacatgtgagcttaagtactcattttgtccccagtggctaagaaactaaaggcaagccagcaagtgtctctgagtttcagtgtctgtatgtaaaaactgactctgacttccatcttctgcagggttagtgatacagatgctagctttttcactaaagaggtcttttagtttatactcaaccttgtctggatctaatttgattgtgcattcatgtgccttagaatgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaaatccattgggccagaaggaatgaccattactaacatgacttaagtataattctgacattgaaaatttataacccattaaatacctgtaaatggtatgaatttcagaaatccttacaccaagttgcacatattccataataaagtgctgtgttgtgaatgaagt

SEQ ID NO: 64205 - DNA, 678 bp, Homo sapiens
ggcatgagccaccgcacctagcccagatgcactgtgtaaaagtaagatctggggaagatccaggtgataggaaggtttttcagggacatgtcagaatagtaagaggaaactgctgattgagaagaggtgtgtgatgtgatcttgtctgctcgaagatggagagttgacaataaggatatgtcatcagctttcatccagcactgttgtcatttgtgacattttaaagtgtctggaagactcctccgtgtctgagatgggtgctgagaaaacacgtgcgtggtttctgcatctggggagtttacggtcagtaccggttagtgagcttttgtctgcacctggtttagacaataaagaaacatgactaagcccggccattgtcttggctccaggcacctgatggtccttgactcgtcctccaggttccagtcctttcccggctttgccattcctgtaggtcctgtcttcaggcaggtagccagatggctcagcaggtccaagttcacatccaggcagtatccagggaaggaagggagacagccttcccctggagctccttcttgggagtgagcagagtgtggaagcttggaggcctcttcgcagactctccctcacctctgcttagctagagttgtgttggatgctgtatgggaaataggatccctatgattgactgagaca

SEQ ID NO: 64206 - DNA, 2272 bp, Homo sapiens
tcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaagggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttggacacgtggtt

SEQ ID NO: 64207 - DNA, 1969 bp, Homo sapiens
tcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaagggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagaggggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagccttggacacgtggtt

SEQ ID NO: 64208 - DNA, 1062 bp, Homo sapiens
gagcaatgtctgcagctgcctttacagccttccaaatggattcattgcagtgtcagcagaaggatttgggaagagggaattaatcttgcctgaatggggacccagcattacagtattaataatggagatagaatagcaaacagatgtggggagtaaagagactatgctggaccttaatttatatttttaataagaacctgcagagagtatttagtgcagctagcctgtacctttttgttgacagatttattctggttaaaagaatatcatttcctatgtggcttaaggattcttccagtctacctgctaggtataggcccaaggcccaaaataacatgaagaatgtgattgagcaagcctcatatttcagaaggggcaacctcttaatttgaaataggacctttcttattgtttttttctggtttaatactatcctcttacatgtgtttcatggctacatagtacagcactttgtattcatatgtcatttatgacaagagtgaaacctctatttgggttttcatgtcaccaatcaagcctagtattttccagtattacatcctggcactagaagaatgtggaaggaatgttctcagatatttacccagttctggtctatgttgcagaagtcaaaagtacttctataggctgcgcatggtgcctcatgcctatagtcctagcactttggaggtcaaggcaggaggatcgcttgagcccaggagtttgacaccagcctggggaacatagtgagaccctcccccatctctacagaaaatacagaaattagccagacatggtggtgtgcatcgtagccctagctgcttggggggctgaggtgggaggatcactggagcctgggagtttgaagctgcagtaagccataattgcactactgcgctccagtttgggtaacagagcgagaccctatctcaaaaaataaataaagaaagaaaaataataaaacacgaataggtacctttataattggctttgtactgggatgactggtttctttttgatcctgttaagtttcttgaagaaaaatgtgattttccacacatt

SEQ ID NO: 64209 - DNA, 702 bp, Homo sapiens
cttcccgggtaggggtgacaatgtcatagtgctgtgagcatggtacttctccgtggaacctctgcatttctgccctctgactatatctactcatgccaaggtggtcctcattaacacctgattcctgcttatctagtgcaggaaagtcttgatgagcaggattcccaaatcaggtttttctaagcttgccctggagtttgggctcataggacaggaaggtagcatggttatgactcagaacttgggctgatgcctctgtgtctacttccttttattcccctagcttattatgaaaccttttaaacataaagcaaagttggaaggattttatagtgaacactcatatacccacaacccaggagtttgacaccagcctggggaacatagtgagaccctcccccatctctacagaaaatacagaaattagccagacatggtggtgtgcatcgtagccctagctgcttggggggctgaggtgggaggatcactggagcctgggagtttgaagctgcagtaagccataattgcactactgcgctccagtttgggtaacagagcgagaccctatctcaaaaaataaataaagaaagaaaaataataaaacacgaataggtacctttataattggctttgtactgggatgactggtttctttttgatcctgttaagtttcttgaagaaaaatgtgattttccacacatt

SEQ ID NO: 64210 - DNA, 241 bp, Homo sapiens
ggacataaggctctaatctctatttgtgtgaggttgaggaggatttgagaaggaagtgaaagctcctagcatgtccccattaccagtcccctgcctgtctctcctatctcaactctcatagcaatagagatcagattttaaattttgaccatgcccaattagtttagtttcccaaggtcatcgtgtaatttctaccatagattatctagtcacatctctcctgagatcactttcccatttc

SEQ ID NO: 64211 - DNA, 359 bp, Homo sapiens
tttattgtgaatttaagattccgatgtatacagccctacaacgtataagcaccaattacattccccaaagtgtgtgagactgcgtcttttccccagaatttggaaccaatgctagaaattatcagtcttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcc

SEQ ID NO: 64212 - DNA, 263 bp, Homo sapiens
gtgttcgttatttagaatccatgtcaatgtttccctcctggaaccttggatttaagccagagagcgcttccatctgtggcttccccgccaccgtggactggctttgatggttatttctccagcgcattcccagcgcattcttgtgaggggtgtagtcttcacagtcacatgtggcttgagatcctctcttcgtgtggggcacacaaacgctacaagccatacggcggccagccaagaaaagggagctgttcatggtgaggact

SEQ ID NO: 64213 - DNA, 277 bp, Homo sapiens
gatctaatcaaggtcattttcagcttcatgcagtgcttttctattttttactaacttctgcccatcactttcaacctagaactttaataatttatcctactgtatttttcaggtcatatatacagtggtcattccaacaacatactcttctgtaagacatttcagacatcactgtcagtttttccaacagcttgactttctttgctagtaatgctttccctttttcttatttgttttacccacagggatatctgcaggactttctgacaattccaac

SEQ ID NO: 64214 - DNA, 799 bp, Homo sapiens
aagaccctgtctctgaaaagattaaaaataaacataacaaaaataaaatatgaaggggaacagaactcagtctgaagtttggaccattgctaaattcagagaaaacagcagaatgtcagtgcctatagtaatagaggaatagcaaggtcaagcctttatcctggctcagaggagaagagaacctcctcttgcacccattcattcaacagctatacttaagagcaaggttttctggaaatggcctatgcacagtcactgaaaatcccagccaaggtcacttcatgacttgcaaatcttggcagagtcatcaggaatatgcccaggcatattcatagctccctgcagcctcgacctcctgggttcaagcgatcctcctgccccagcctctcaagtatctgggattacaggtatgagccaccatgcctggcccccaattttttagatgaggaaattattattattatccccagtttacaaagaggaaacaggcatcgaggacttaataatttgttgcaagtcacatatccctggaggtgcagcccaggtgatttcagagtgtgtgatcttaaaacgctaggctaggctgtctccccatttacagaggtatgaacctggactactgtccatgtgttcttcccacagcaacatgccaaggtagaaagaggactggactaggttcaattgatctgggttctaatcctaatgttttctctgtgcatttttgagcaaattaatcactctaggactcaccttccttatttgtaaactaaattcatcactctagaactcactttcctta

SEQ ID NO: 64215 - DNA, 390 bp, Homo sapiens
aataatttttttgaatgtcattaaccaacccggaaactgtgaaaatatcgaaaatcaaaattcaaagtttcagccgccgagaccaagatggtggcgagacttggcactttcctcaagaatgcctgggccagggagccagtgctggttgtgtccttcatcattggtagcctagctgtaattctgcccccactcagcccctacaccaagtacttcatcatgatctacgagaccatgccctacaactacccattgcccgtccgcaatgatgggaacatgaccaatgtgcccggccacccccaggatccccagagctccagcttggagtggctgaagaaactgagcacctccactgacagaggaggcccctcccatcgctcccaatacgaatgt

SEQ ID NO: 64216 - DNA, 384 bp, Homo sapiens
aggaacagccggaaaggcaggagaccccaggttgctgggtgcccaggatggcaagaatgggctccagggaagagcacatagccctgggccactgtgccgagcctgagccaaggactgagatgagaactgtggttgactcagcaacgtggagccattcctacaaaacttgctccagttttgctggtacagggacactgcgagtggcaggggcagcagccacctgggcaggttctgtggagacacacagtgggaagctctgagctcagctcaccacctgcaagctccgacaaccctgccgcagcctcatgatattggtgctgcccttagttgataggaaacagctcagagaagggacactgcttgcttagagtcacacagcaaaaa

SEQ ID NO: 64217 - DNA, 429 bp, Homo sapiens
aatgtttaaaattaaatataaaattaaaaatatggaaatgatctttatataatcagaacactcacaattttgtaccctaaatgaaatttaatgaaaaatttagaattaaaagggatataatttttacatcttgtaaagtgagttcaaaattagttaagcaacctcagcttgaaatgacagcttgaaatgacactatagtagcaaaacttgctgattctactttttatgaatcagtaatgggcgagaagtgttcttgtatgtaagggattactgataattattatcaacagaataaaggcttactctaacaagatctggggaggattatagtttggcttaatacagttatgttcatttcctctgtgcatatgtatttaatggaacttctttagcgtggtcgttagagcattgtctcttctatgatgtggc

SEQ ID NO: 64218 - DNA, 5349 bp, Homo sapiens
  misc_feature (4509)..(4509): n is a, c, g, or t
gagggacctgttggtctcaaaggaggaattcacagggcttctctatcacctgcctgggaatgggtaggagctggaggaggactgccgttgccagagaccacatgagcactgacctctggccctggcagcagcagtagctgctgttgcaatgggtctctgccatgccccagtcctcggggaacatctgcagatcagtggttgtcttggaataggccatgggaaagtcaagagaagccacggctcttgaaaaccatcccagaatcccactggaacgctgtgccagaatacactgagccctaaaggtcttgggttttatgctattttactcatttttattttttggctgcagttttagttggaaattcagaacactaaagttatcccagggcattggttccaagcaagtcacatagctctcctgcagctgataactacgggacctgtgttcaggatccacagcaaatgatgcaaatcagcctagccaccaagaacaaccagtctctaaaagagacccaagtccaaggaagcaaagactgagaccaaaacccaaatcttgtctccactccttaaatcttcctgccatggccaggggaacgtaagttacttgagggcaggcacttgcctcattcatttctgaattcccagtacctggagcagcccctaacacacagtaggtcctcagtaagcatttgactaaagaaatggataggccgggcacggtggctcacgcctgtaatcccagcagtttgggaggccgagggaggtggatcacctgaggtcaggggttcaagaccagcctggccaacatggtgaaaccctgtctctacaaaaacacaaaacaacaacaaaaaaaaagtagctgggcatgatgctgggtgcctgtaatcccagccactagggaggctaaggtgggagaatcacttgaacctgggaagaagaggctgcactgaaccaagatcacaccactcatggcactccagcctggatgacagagcaagaccccatctcaaaaaaaaaaagtagataaactactaggccatacaaaagaatctctaggcagagtgacctcatcccacagcaccgctcatcttagaatgtgataggagaggtgataggaaggcaaaggttagcaaactggcccatagaattctgtttttgtacagtccgtgagctaagaatccttttcacatttttaatggctggaaaaaatgcaaagaaaaataatattttatgacacatgaaatacatgaaattctaattttggtatctataaataaaggtttattggaacacaaccactcccattcacttattggtattttctgtggctgcttttgaagaacagcaacagagctgactagttgcaatagagactgcatcacccacaaagctgaatgtatttgttatctagccatttacagtaagagttttccaacccctggcctaaagaatctccccagttaggtacatgtggtctagatccccagcgttaactgtttggagttaagcattgttctctcagctcttccttttttcatttttatttatttttattttattgcaaattgacaatttgtaattgtatctatttatgggcacaaagtagtgttatgatttattaatacaatgtggagtcattaaatcaagctaattaacatatccatcacctcatggctctttcttttaaatagaagcctttctagggtggtttaaattactcttagtagtataaattttttgacaatttctctccctgaaaaaagggacgtgatcaaggataaggagaaacaagggaagacatatttttaaaagggtaaaggacacaaaaaggggaacttccaccaagaaaaactgggtgcactttataatgttcctaatggccggcactataccagggctttgggaaaggacacaaaacaggaaacttctctgagttcacagaaggaccccttaccttgccctgaaacagccacagccctgcccaggctggctcctccaatctggcctccttcagtacctcatccgtcctgagcagtgtgagcgatgctgtctttggacgtctcacctgcaccatccacagggcaccacacacaactctcctgagcagtggaaatcatggtattgtttatttagatccagacataccaaatgacatccatcccttcctccccgcagaaaacactcatcacagcaatccagtcagcaaacaaaatgactaccacttgccatttctgattccatgcttgcctcgagacagagaactccttgcaagtacaaattctgccttagtgatttttatttccctgcacctaacacaacatctaacttgtggtacgtataatattcaactaaaactagtcctctcctctttttccttttctttccctgtcatgcagctaggagatgcatggaatccaatgctctttccactgaagtggaaagtaggctgctaacaacctccccagaatccttgtaagtaactcctccccaggggagaacacacatctacaacttgagcctggaattcaggtcagcttggtatcaacactcatccagggtctccccatggccagtatggcttttgtcccccttagatatgctggaggaggagtcatctaagtttgtttttcctctctagtcttctgatcagctaggaggatccaaggttccaactgagttctcttgcttcaccttgggcaagaggagaaaaaacagtcacttgtacacctaaccacaaacccctgaccctcttcaaggcagaggaaagtaactttccaaactcttcttgaataagaagaaaagaacctctcctctttcaacaggtatttctggctgctggggagggtgttattaatacaagaatctaaacacaatagcctgtctcctggcagctgccattcccatggcaacctctgactttcacggactcctttggatactaagggcctcagagacagacttctaaaacaaccaaatttttcaaaagtgaattctcagggaacttattcctctgtcagaacagacccctcctaaacttccatttaaagagaaaacctaaaatctgctgttttaaaaaaaaaataacagaaacccccattaagtgctgttatcacaccaaccctcaaagctatggaaatggacaatatagaatttaaatttcacaggtgaaaaaaaaagtgtactaagtgtgagttgaggatgggagatggagatctggtggactaccagcaaatggagatagccatgaagaggcatatttgggaaggtagttcacaaacctgaaccagaagagactcacctggagaacatgttcaaataccgattcccaggccctgtccccagggattctgattctgtaggtctggaatgaaacctggatcacttttgaaagctcttccagtgtccagatgaacattcaaattgggaaaccagcaatctgaagcctattccttgccccttccccaccatggtccaagggtctcctggctcttagctccctcaattcctgccagccctcaattctagaaccagagtaaaagaaactcattttctttaaaataaaaggaagaagtcgcagccctgaagtgcacgtgtgctctgttaggcgctgtacccagggaaccttggagctggaagccgactccagccctgagctgtgggaaggttatgtcatgctcttggcttgctgcctggtttccactggggttgctgcctggtatattttaggtgctgggtttgcaggctagtactctgaccttccttggctctcccccagggagcagccaccaggctcctgctgtatcaagagctacaaggtacaatttccatggcatccaggtaacaggaaccaactggcagcaatagctgggacctgcattagacctggggaggcagcctgctggagaagaaaggttcccggatgtgagcctttgcacgtggtattagcacggctattcacagctgtgggattcggggctagccactgtccttccatgggcctcagtttctcagctatgaaactaggggctcaacaaggggttcagcatagaatagtggaaggaatgtggattctggggccagaagactgaggctcaaatcctagcttcatcactgacttgcttggtgatgttgggcaagtgcctgaacctcgtcgtgcatcagttctgtcatctacaaaatgagtgtaatggtacctctcccacaaggctgatgtgtcaagtaaagatgatgtgtgccaagtgcttggcttacacaccactggagatccaagacacccacacacacacactcacttcttaaccgggaacctgatgaagtgggtgccaaatctggatagagatggtctggagggggtttagaagacggagaagtttctctgtgcatagcacataggaagaaagggaaacatgaatttctgaaggaaacgaagtttgagttaggattttgacaaattgagaaaatatgaataagcaactacaggacaaaaaactgaagaatagaagaaaaaanaatctggaatccggattgggaaatttggattctaatcccagccctttcactgtccagctttgtggtctgctgatatgttgcctctgttgcaggaaaaaaaaacaggttcttttcacactactcggaaaatttaggctcacggacacattgtagggtgagatgcgaggaagggtttattgggtgaaaaaggaaaaaggaaagaggaactctcagcaaagcgagagagtcctgctagcaggcccgcaccttgcagactgaatcccaggccactacataggaactgaagaggccagactcctcctccctgctccacctgcttcctttggtgcgcattattcagacagaaccaatcaggaaagggtggacttcatccaggaccagcagtccggtttttcagccttcaggattgttttaggttttaggtgggttttcgccagggacccttgtctgtctcctgtctctatcacctctttatctatggaatggggctgtggcaaaaattaacaagatgacttaggagaaagcaccttgtatagtgcctggaacacagtagatgtttactggatggatggacggatctatggacagacagaggatggattccagatggagaaagtggggtgggcaaaggaatagaaagaggaatgcccaaggcatctttataggtcagtgggtatatctgcacagttcagcaatttctgaagagtgttcttggaactctagcccctaagatactcctaaggggaaaaaaaaacatattccctggtcaattaaacttaggaatgacagtttgatacaccactctcctgatgatttgcaataaatgtcaacgtataaatg

SEQ ID NO: 64219 - DNA, 2684 bp, Homo sapiens
cagctgctgtctgtcagggccctgggcacagattcagagctgcagaggcacagcctgcctgttgtcggttgtaagtgcccatgtacagagtgagtttaatatttgagcaggccaggaagcacctgtcttaaatttggcaattaggaaagggaatatttctcctcatgtgttccctctctgaacacaataaactgcacaaagactaagcagatcgcttgcctccaaataggaattgtcttcaaagagagtcattttaggatgggggtgaggtcccatcctatgggttctaacacctcctgcaaaagcctctgagcttctcaaggtaagtataagggatatgatagccattcaacaattagtatgtattggcagatcaactgactgactgaatgaatgaacaaatgattgcattaagagctagcgaccctggaaatgattcctgtagaaaaggagaatatgagggtccagcttggaaactgggagggcgttcctggggataaggccatgtctgtgccaaatccttggaattctagcaaactcagcagtgccgtctgtccaagaaaaagagttgagaagtccctggcagacacagagggttttggttagaagatgagggccccatggggagaaggaaggagggtacaagtcatcagatatgagtgagtccccataagactctagctagggaggggccaatgcatgttgcacaggtctcctcaccagtctgtggcttccatgcacattctggggatagcagcacctatttggatttccactgaaaggtagtggctttgaagtgagttggctcaggggaaatttcagctctatccacttacttgggattggaacttggggcaagtttcttaaacttgctgagtgtagtttcttcatctataagatgggtagaaaatctatcttgcaggaagaatcgattatttattaaataggtatttattggtatgaggtcacacattatgttaggtgctgaatatagaaagtaaaaatagacatagctctttcccttaggtgacagacagaaaattaaacactcacgtaaataaatgtaacattatgtctataagacatcctatgagtagaggtacaaggtgtcatacaagcccataatagaggaattttacctagttttggagatcagaaagtgatggtgaaggaaaggacgaggatgaatgtcacagcattcaaggcagacagaacaagcaaaggcagcaccctgtggcacagaagcgaggggtgggtttgtgatataggggtagagggcaggtgccttctcctacccctgctcctgtcagcacaccggtgggtctacctcaccccaaaccatggggatgcccattccaaccttggaggaaggctatacatagcacagttccatgttgaggctgtggaacccgacccctcaggttcaaattctgatttgatcacgtcctgactgcgtgatctcaggagagttagttacatttcctgtctgtgcctcaaacagaaatgataacactagtaactaccttgaggggttgtgatgattgagttaatacatgtaaaacgcttagaacactggcttacctcataagtgctaaaaggagtaggtgttactcctgacattccttccttaactcatggccctcagttataatacttacatggttctcggcatgagccctcttccctccctctgcccagtccaggaagaggctcaacccccgatgttcctcatcaccccatctggaccagtgtgactgcaccagcctgtagcattctctgtccatcccggtccctcacatattcaagacacacatgtaattttacattttccagtagccatattagaaaagtaaaaagaaacaggtgaatttaatactgtactttagtccaatatagccatttatcatttcaacatgtaattaatattaaaaattattacattttacattctgtttttgtactctttccaatccatcatgattttaccctagcagcacacttcaatttggactagccacatttcaagtgcttgacagtcacaggtgactaatggctctcctatgggttatagcccagctcttgactctttgatccacaaggataagaaccacatccacttccacatctccaggtatgaggcagataaatagcagagagtgattacacaaaactcttctcaccacggattccggcatttgtgggcagctgcagaagagtaggtgggaggatctcccagattatgaggccagtttttctgtggctcagagactgccagtgactcgctcaagataaaacagcttgttagtggcagggatggagcccagaaatcctgtttcctgtcctcaggagtgtgtgttcgaaagaagttcttggcaaaggtgagaataaatcataggctctttgaagaggactccagtgtattaaacaaataggttgctgagatgcagttaactactcagtaatgtagttgaagaaaattaatttttcattctgccactcagaatatcgaggctggccatctgtaaacacagcctgtctctaggagaacagaggtggaatcctccttgcaagtttaaaaaaataacagagtaatctcagtggatgtcttaagagaaacataattataatttagttgacatatctcatatctcagtgatggtaaataaaccttccctaaataattc

SEQ ID NO: 64220 - DNA, 633 bp, Homo sapiens
gtgggctggaattagcatcaggatctgacgtgtgagaccagtctttgtgaagcccttgtctgggagctgaagaatagaacatgatgttagactaggtgtgctaggatgagtgtgtgacctctgttagatctcgctacgactaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataaaaaaagaagagcaaaggaaaaaagagaaaacaaagaaagagg

SEQ ID NO: 64221 - DNA, 1498 bp, Homo sapiens
gactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctc

SEQ ID NO: 64222 - DNA, 504 bp, Homo sapiens
cagtgtcagcaggcggtgggttagggccgcagcccagaccaggccgccgacaccaataagctacaaggaggagctttaccgctgcctgtactactactgcctgcgctacttcccagcctgcggcgtagggcgcagcaagggcctgacgcttagcgagcaggcgctgcgcaccaagcggctgtcgcctggagggcacgttcaggcagaagctcctcagtggccacaagtccgctagctccggctacagcccttgccgcacactcgcgtcacctgagcctgtgatgccgaaggacctgttcaaagtattttctgtaactccaactgtaacttggttctaggaggagagaatccatgtttggtcaacagaacttttcgccgccacttaagtttactgcttcaatatcttttccttactaattgattgttaattaagtagtgtccaagtgagttagcctttttagggttgattaattaaaagagcagcaagaatggcattttaactct

SEQ ID NO: 64223 - DNA, 415 bp, Homo sapiens
cgttgcaacaacatcaaagcctttggaactttgtagggggtacgaggggctaggaaaccaagaaaacatctttttaaaaatataagcgatcgggccgggcgcggtggctcacgcctgtaatcccagcactttgggaggccgagacaggtggatcacgaggtcgggaattcaagaccatcctggccagcatggatgccgaaggacctgttcaaagtattttctgtaactccaactgtaacttggttctaggaggagagaatccatgtttggtcaacagaacttttcgccgccacttaagtttactgcttcaatatcttttccttactaattgattgttaattaagtagtgtccaagtgagttagcctttttagggttgattaattaaaagagcagcaagaatggcattttaactct

SEQ ID NO: 64224 - DNA, 918 bp, Homo sapiens
tttttatattcatttttcttttgctctcataaggccataaagtatattttttcatatgaccagagaattgtccaacttgctttcactgtaattttgctgcatccaatttataaattcttttggaaagaagattatttctttatctatttacaagggattgaaaaccacagaacactaaattttctgtgcagagacatagggaaatgaaaaaccccacacagaggtctcctgccatttccttctgagtgtaaactaagatgtgattttgctttttctatttcagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatatttttcaaaggc

SEQ ID NO: 64225 - DNA, 150 bp, Homo sapiens
gttagtgggtgcagcacaccagcatggcacatgtatacatatgtaactaacctgcacattgtgcacatgtaccctaaaacttaaaagtatataaaaaaaaaaggggggggtatacacacaatcaggtgtcaagcagtggcacctcgtgca

SEQ ID NO: 64226 - DNA, 258 bp, Homo sapiens
ggtcttgaactcctgacctcgtgatccacccgcctcggcctcccaaagtgctgggattacaggcgtgagccaccatgcctggcctcttaagatactctggagaggaaaaaaaaacaaaacagaaaatgactcttaactaaaagctaccatcatcaaatccttgaaattcacagaaaaaagctagaaaatcacaatttaaaaaatgcagttgaggcaagtaatattcacagagaaaattatacttgtgctctgaggcta

SEQ ID NO: 64227 - DNA, 328 bp, Homo sapiens
caagggtatatgagtagctgcgctctctactagaacctccaagcaagcgctcaggaattggcaacacggagaagcttcttgagctcagtgtgattatggcagaaactctgaagctaaagaaacttcccatgttgctgtggtcacagctcaaggggacatgaagaaacctttaaggatggaggtgtgtctactgtcttcatcctggtgatgctttcataggtatggacacaatatcaaaatgtattcaattgtacaccctagaaatgtgcactttattgtgtatatattatacctaaataaagctgttttttaaaaaacaaaaacctaa

SEQ ID NO: 64228 - DNA, 416 bp, Homo sapiens
tgattatttattggcatcaagaacttgtgagataaatagttgtgtttcctgttagtagaaaattaatgcacaccctctgtggaaaacagcaaggtggctccttaaaaagttaagtacagaattccatatgacttggcaattctactcctaggtatctacccaagagagaaatgaaaacatatgtccaccccaaaacttgaacacatatgttcatagtagcatgattcacaacatccaaaaggtgaatgggtaaacaaaaaaaaatccatacagtgaaatgaattcagccctaatgaccaacctggacaacatagcaagaccccatctctacaaaaataaaaataaaaattagctgggcatggtggtgcgtgcctgcagttccagctactcgggaggctgaggcaggaggagaatca

SEQ ID NO: 64229 - DNA, 391 bp, Homo sapiens
tctgagtcatgctgcactgcagtcctcacattcacatgtgctcctgagcctgggctcccatgcttgatggccaagcctctttgagcatcagcgcttgcacctgcctgggatgctcttcgccctgctgccatctgtaccatcccctttgcccagttgccccctacatatcattcaggttctagcctaaagggctcatctctggctgatgtttctagacagggctgggcagcctggctccctgctttctattttttagcattcttttattattattattattttttgagatggagtctcactcttcacccaggctgggttgcaatgagccgagattgcgccactatactccagcctgggcgacagagcgagatttcgtctcaaaaaaaaaaac

SEQ ID NO: 64230 - DNA, 433 bp, Homo sapiens
catcctgttgcaccagagaagagcatggaggagtcaataaaatctgagaagagtctctcacccctcctcaatgcctcccctctggccagatgagattgctggggttcagagacgtcaagcagcttgcctgagagaagccacgcagctaatgagcagcagagcccgattcacacccagacatctggccccagggcatgtgtttcttgccactcactgcctcatgccttctctttgtactgccatcgtttgtcacccaactgcctctgcacctcggccacgccacccttgaggatgggggctggtacctcctttatcttgtatccacaggaccccacagagtgccttccccagagcggtttctgctaaattctgtttaacagagtgtattcattctgtttgctgaatgaataaacaaccacatgaatgcataagt

SEQ ID NO: 64231 - DNA, 311 bp, Homo sapiens
ttagtcatcgcaattccaaaacggccctgttttgattctacagttgcttccccattccattatcgtgtcggccaatgcctgtctattctcagaccttttaagttttggggtgatggtggcattctccttagctttttttccccccaagtgtgctctataggaaataaaatgttcaaagactacaggtgattaaacaggggaaccaataatgagtatgtgatggattttttattagtcataataattatttactacatatggagaaaggggaccaggcacttggacttggaagcatttagaacagtgcctgg

SEQ ID NO: 64232 - DNA, 326 bp, Homo sapiens
cagaaagtgaaaaaacaacccacagaatggatggaagcaaatatttgcaaatcatatatctgataagggtttagtatccagactatataaagaactcttacaactaaacaataaaagacaaataacaatttgttattaaaactattaaaaatgggtaaaggatttgaatacatatttctccaaagaagatacacaaatggtaagtaatcacatgaaagacattaaacaggcctggcatggtggctcacgcctgtaatcccaagaggcaggtggatcaccaggagatagagaccatcgtggctaacatggcaaaaccccgtgtctac

SEQ ID NO: 64233 - DNA, 466 bp, Homo sapiens
  misc_feature (459)..(459): n is a, c, g, or t
tgcatgcctgtaatcccagctacttgggaggctgaagcaggagaattgcttgaacccgggaggcagaggttgcagtgagccaagatcacgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgtgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaanatcactt

SEQ ID NO: 64234 - DNA, 541 bp, Homo sapiens
atccatgctcaaggccacttgaagctgctccagaaattcaggcttggacagcacaaccttagagcacccgttccctggattggagccaaacagtctggacatctcacaagagacctgcagagatgtaaggacacactcacctcctgtgttggggaaggagtgactcagctggctggaacacagtggccaagagggtcagataatcttgctttatttcctaacccggaccggcctttgttccaggacagggatcctggtcatagatccaaaaacaataatcacaaatccatcccacatccaggaaagggaccagatgcatattctgctgatagtggccaagaacgtggctggtctgtgtgtctaacgggcagtgcatggtgactgcactgcatcaaccttaatgggatcttctggaagaaatgtcggtgtggggaattgtagaagattggtctttgtttccttctctgatcaatagtctcctccaaccccactcccagcacatacacatgaaagaaaataaagaaaaagaaaaaacatgcta

SEQ ID NO: 64235 - DNA, 956 bp, Homo sapiens
cattttacttctctaaactgtaaatctaggataaccatacctgtattgaagcatttttatgagaatgaaaaaataaaatgtaaaaataaaggcagtgggtgtgaaagtgttatataaatttcaaaatgcaatgtaacttacttttcagaaagttaagtaggattttagcatatccaaccatctttccagggtgattaaaacttgaagactgaattcatgggccagatacagttggggacagagattagcctatttgcaatggaacttttgaggtccttagaatggtcgtacatttttaaaatctttatattctccccagtgaggctcagtgacagaaaacaccaacatttacccaaacaactgccccgttcccctggtccttagtgagtcccttgagaaactgcattattgggataagatggaattaagataaaaactgagcagtaccaataaaaaatatgactttaaaagggcatgaaagcaaccgttatttagtatctgttattgctgagtacaatgtaatatagaacttgaacttgaattcaaacttacactcctccaaaacctgtattattttctccaggccctgccactagccagtgagggaaatagatgaaatagatctgactctaccttgaaggtctgcagcaggggtcagcaaacttctagccctcaggtcaatagcctgccgcctgtttttgtatggcccatgagctaagaatgatttgtacgtttttcaatgttttaaaaaattgaaaggagtataatgtttcataacacatggaaattatgtgcagctcaaatttcagtatccataaataaagttttattggaacacagctacgctcactcattagatattgtctatggctgtttttgtgcaaaatggcagagttgggttcagagttagcaacagagagcttgtagcctgcaagcctagagtatttactatctgg

SEQ ID NO: 64236 - DNA, 6431 bp, Homo sapiens
agcgggggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctaagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggagtagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgacctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 64237 - DNA, 6729 bp, Homo sapiens
tgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctaagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggagtagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgacctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 64238 - DNA, 6377 bp, Homo sapiens
agcgggggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctaagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggagtagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgacctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagaccttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 64239 - DNA, 6668 bp, Homo sapiens
agcgggggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctaagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggagtagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgacctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaacaaaaaaaaaaaaaaaaaaaaaggctgttggggggcccggacccgaagaagttttcagaaccctcgcggcggcggcgcgaccagagtaaggcacggcccaagcggcgccagaaaccgtgcgaacagggcggttctcccccaaaaaaccggcgccgcggttggaaaaccaaggctcgcgctcgctgcacgctcaacatcccccccccgcccgcaccaaagagagcaaagaacagacgcca

SEQ ID NO: 64240 - DNA, 6043 bp, Homo sapiens
  misc_feature (6)..(6): n is a, c, g, or t
cagggntctttccctcaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatgaaatctactttcacagctcccacatacgagtgagaacatgcaacatttaggcctggggcattattgacagagaattgttgctttgaagttggaaaatgccttatggtgctaaaagccaaagagaggcctctgagaacttgaagctaaccatgtgttcctttccagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctaagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggagtagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgacctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 64241 - DNA, 4824 bp, Homo sapiens
agcgggggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctaagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggagtagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgacctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttc

SEQ ID NO: 64242 - DNA, 3368 bp, Homo sapiens
gccggtaccggacttcctggtgtgttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgatcaggtttacattgaagtggcttggaagacgtatttcagagggactgggtttgtactgcaaaactctgaacactagagcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 64243 - DNA, 2040 bp, Homo sapiens
tggtgatagtgttctagaggatcccggcaggttctactagcacttgggcagtaaggtagcgggtgtgtattatgctattgccatagttctcgtctttgtggattcacataccctttcccatgaggagcttgctactaacagcctcctgtttctgttgtttttatatgggagaagagaaagagcttggaatttcaattgtctaaacaattggtatgatttacaagaaggcaaaccattcaggagatgttcaacagtgtatcattcttagcattcaatacaatgtttattataaaatatacacctgagtttatgtttttctgccaggctgaagggcaataatgtcttgctatgcaaacactctattttatgtgtgaatttttttaactgtaattttatgtgtgaatttttttaactaaactctatcatcattttctatgttgacatcttttttttttttttaatctgtttccaactctgagtctgtgaactatctcttctgactggatgctggcctaaaatcctattagtgcttaaacagacctcaaaacactctgaacctgtaggccaatacagagatgttgttctttgatatatcttgggtccttgatggcttcaacaaacaaggtcataatttgtttaaattcagtgttttctgtagataccttcttctcagtttcattaagaagagtaaccatctttggttttccaaagaatggaaactcctaccctagactttagacttagagcgtctgcctttcacgatgagtaagagatccagaatgtttaggggatgtgcgtcagcccacctggtacagtggcaaagctgaatgcgaacttgaggcctcctgaggcctgaccttctatgcccccagccctccaccccaagcaccttttggtgtggctggaaacacatgacattggatgtgatttttctcaagcccttcactgtggaaggcatgggagactgcccagcattgggcatgtggctgttaacgtttccatttcaagtccctgattcttactggagaagttaaggagccacttaatgttttcacagacctctgattctgttgtgaatgtggcattccagtgagtacaacctgcttgctataaagaaagcagcatattttgacaattttatttcttccttgggtacttacatttttattacaaaaatggccgttataaaaaaagacagaagggctgggcagtggcttgctccctagaaactgagattccgaagcaggtgtttcctctcccctagactcagaggtacatttaatccatcttctccatttcctccttcaggaccagctatgagattcagtgcatttctagcccagcggatgttcattctccactaaacttcatcttttactaagcaaagggggattattccatgaggcagccaggagcaaggggccatgatattcatgactttgtctgctgggcatttttcaaagtgtccttgaattcactcagcaaacaaagctttctggagaatctctcaaaacttaggccctgctccatttggccaaaaatgatggctgctccaaaactctgaacttcttaaaactccatctgctacattatttctggagtttaaacatgactttttctgtctttgagtatagatgtgtttgtttaattaacgaagcacaagtctgttaagcagaaggctccaagctgtattctatacttgggaatccttggtgccatctttattctaccaagtgccaatcaccatggctaaagtgggcgtatattacagcctgtgtcctaagcttagaagctttaatgtacttttttaaatgaaaagtattagagggggttgaacattgtaactaaagcataaagttagaccaattacatgcagagatgtttatttaatattgtgtgagctgagtccttctgtataaattatttgcacacttttcttgcatgatgaactgattttttatagttgtttgtaccagacggtggcatatttttgtaaaaaacttttgacactgaattgcaataaatgtttttccaacaaca

SEQ ID NO: 64244 - DNA, 1197 bp, Homo sapiens
agcgggggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatt

SEQ ID NO: 64245 - DNA, 1317 bp, Homo sapiens
  misc_feature (1147)..(1147): n is a, c, g, or t
  misc_feature (1286)..(1286): n is a, c, g, or t
  misc_feature (1296)..(1296): n is a, c, g, or t
agcgggggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggagaaggagagcaggaagcaggctagtgagggccatgcctgttgctggagtacatnggtataggccctgtgtgcccattatggggtttgagaggtgcaaggtaatagctggagacattctgaaattagttttgaggttctggaggggacacaccgctggctggtgaactcgatcacattcccaactcttttaggnccagtacctnccattacagaggacagaagag

SEQ ID NO: 64246 - DNA, 959 bp, Homo sapiens
tgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagcagttacctgccacacaggacggtatagcaataacggacgaactctctttcgacacagcctgacactatgactgtctgcagccacagaagacggaacacgaacggacgatgcttgaaactagcaaccaccgaaaacatcagggtatttccaccaagaacacaactggcatctatgtgcacaagaggaacgtactaaagagcgccatggatattgcaccctgggggaagctttcaacagactggacttctcaactgccattctggattccagaagatttaactacgtggtccgggccctgccactagccagtgagggaaatagatgaaatagatctgactctaccttgaaggtctgcagcaggggtcagcaaacttctagccctcaggtcaatagcctgccgcctgtttttgtatggcccatgagctaagaatgatttgtacgtttttcaatgttttaaaaaattgaaaggagtataatgtttcataacacatggaaattatgtgcagctcaaatttcagtatccataaataaagttttattggaacacagctacgctcactcattagatattgtctatggctgtttttgtgcaaaatggcagagttgggttcagagttagcaacagagagcttgtagcctgcaagcctagagtatttactatctgg

SEQ ID NO: 64247 - DNA, 4423 bp, Homo sapiens
  misc_feature (4364)..(4364): n is a, c, g, or t
  misc_feature (4410)..(4410): n is a, c, g, or t
agcgggggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccagcaagactataagggcaataattctatttcagcggtgaaaatggagtcctcttaatggtcacagaaactctcttatagttccctaggaagaaaaaggcaaaactcaaatacaaaataggacgctttgtttacaatgtgaaaatttgtttagaaaagaaaaaatgaagaaggaaaactatataggagaaattcctgggctttggggtttgatctggtgtttgttttgagaaggcgaaggaagcgccacccatcctaaacctgcatgggcacagagccttaccctacagagataccacacaatggtctacctctaaaagcgtagagtgccctctctgacaacgcatgtgatccagtaggcagtgtctgtttttctcgtaagtgttttcatcactataaaaagtgatttaaaatggaaagggatattggaggcaatcctctggtttcacacttccttttcaggcaaacagggccctccttagagttatctgttcaccagaacaacccaaaagcacatgttccttttttcctgtcatgttgtagctcatttgggggaaaagaaggccaacttaaaacagtcccaggggaggactgcttgagcccaggagtctgaggtttgcagtgagctatgattgtgccactgcgctccagcctgtctccaaaacaaaacaaaacaaaacaaaagccgtcccagaggaagtcctgctgcagaaaagatgatagaattggtcacccaatcaatagctgtgaagacttccttattcctgctgaacttccttccttggatatcttcatggataagcctgtgtctgtggacagagtggggcccaagtgctgaggctcgaaagacaggttttacaatcagccaattaaacatcttaccagttgctgtaccccttgccaaggggatgagctgaggagcttcttttctttaggtccaacatcaaaatgagtccatctaagctagggctttttgcaaaggtgattaaaaatcaaggctggagttccagccaaatagggaggagaggtaccacaagttcatcttaaacttgcttccgggctgggtagttaaaacaggaagatcccaaggggatcttacgaggcaaatatcagcaggtaactgtggaagaaaggaaatctcaggacctaatgagttcgttgtaaaatattcctgggagtagatgggggatctactcccagttttttactttttacagaatattgttgctttcctacaacaatgtacatatatttgcagttgtatatgctttttttttttccaaataaacttgtcaccctgcatgcccttggcaaataagtgaagcagaaataggaacacagtccacattcaagttgaggaacagtgtatctttaagagctgacctttgggtgacctggaaagggggaaagatggctaagcatggagagaaacgaggcaagagacaagctatgatacaacaccgcttcagcccctgccctcaatagcacacaacccacatatcagctttctgaagagaaggaacctactgtttagtgctcctcactttgcaatgtttgtgctacgccagaatttctccagtttttttcattatcatccccctgagaaaaaaattacattgaatttaaattttccctaataagagaaattaaatatgaaagaataggattttgttgggtaagattgagctttggaaggtcacgaaccattattctatctaaggtgtgtgttttgttttgtttttttttgttttttttttgcaatccctctccccctgaaccaatttcacattgggaatgcaggacctagactgctgaataaaaagctacttcttctataattgtcaggttctctccaatttctcagcttcctcaaagacatggggtggagttgggtgtgccatcactgagagagctctggaacttttgactcttagtgacatttttagatttaggggttcatggccttccacatgttgccaccaactggtgatctctgccccttcatgctgatcaagaaagtagaaactcctcgtcgccttcaggtttgcagtcgcagaaacattgcctgctgtggactgtcagcacaaaactgggacactggtgtcatttagactgtcagcagtgcacatgattgtacgatagactccaggcaaccatgtgcatctgtgcaagatgacctctgccccaagagaagggttacggtctaattaaatgtttaccaagatggtaccagtgggctctccccgtgtcctttggtgttattggagctggtgtatgacagactcaaggaaattttttaaggaaaatgaagaagaaatcaacctttatggttctctttcattggaagaggagaataaggaaagaaatggcaggtagagagggagggggaaaggaatagaaatggcatgtctttgatgctgtggcttgtgtggggacaatgggaagagcacagcaggcacaacatatctgtgttagtgccacgtggtatctgttaagtatggccagagcctcacatataagtgaagagagttaagacaattcttgctctttgaacaataatagtctatagaatttctattggcaaaccatcccagacaacctgacctatcaaacaaaagcaaataatccctgtctcagaactgctggtctaaaagctagaaggggcatgataatggaaattgctagaaaagagagaatgctctactctctttcctgtgcctacctacccccatcctaaaccctgtaaaacagaatttcaaaatagatgtcaaatatgaagtaattcagacttccaaagaaggaaagagttctgcccagggcagtatgagcaaatccacagggatgttaagatttggtccaactcaaaggtttatgggcagtgagcctagagtctcttgagagtaaacccttgcatttgggacaaggagaatatgtgaagttcaggagtgctcacactagagcaagatccagaaaaaaaaaaatccaatggcattttaaactagattgcattatcactcaatgctgttactttgagcagacaaatcagttgaatgggagggcaaatggcagaaatgaacaaaagctattaggtgaaagcatccccaatgtatcagttgtgagatgatttttgtttaatgatgaaaagacattgaagaatccaaaatntaaagatagagctggaaaacgtagggagcaggttggaagtgaaggnactttccaaagag

SEQ ID NO: 64248 - DNA, 605 bp, Homo sapiens
aaaaaaaaaagccctcccatgccagaacagaggatggcagtctgtttcaataagacactgtgtccttggtgttggttctgattaagactcactgagatccagtgctcttgagctgggtctcagtcccctcccatgtcctgtgctctgccgccactgttttcattgttgtgttctcgttgtgattgttaagactcacactcctggctcagcagtggttttccagaaggcccaaagagcggtgccgggcaccccacgtcgcagtgtccgttccgggcttgggaagctggggaggtgggcagacctggtcgcatctcaccacacacacacacacacacacacacacacacacgctgtcagaaactcggccgtcccccctacctctgagctctcaatgctgctaatctctgccaagtgtccctgtgctccagcaccttccttgaaggactgacgcccaccccacgctctttgcgaggttgtccaggctgtgtttgtcgcatgctcttcttctgtatagttctcatcttccaattttatgggattcaacaaaagcctattatgcttgtttgcattatggttacaatattaaaaagtggattcaacaaaac

SEQ ID NO: 64249 - DNA, 624 bp, Homo sapiens
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggatgaagaaacggaggcaccaagatgctgaagcccttgaccgagtcacgtgtcagtaaatgacagaatcaggatttgaatcccatgcctgtgaccctgaaccatgacattcccctttaacccttccttccaacctctgcgacatcagcttatagactgttgaaggtgacaccgttctcttctgtgatttttatttcaggggttatttgcagagctctgttcagtaaagctgactcaggtggggatgtgtcccgcagtgtcgaggtagggtgtcctccaggggcttcccaggtgtgctggtgcaacacgagataaagaccaagccagttcaggtaacccccaggtagagtcactaaaaaa

SEQ ID NO: 64250 - DNA, 7347 bp, Homo sapiens
ctagggacaaatgcagaaattcgtccgtgaattcgtcgtgtgaatgcagaaatatacacggatgtgcacacaactacagctctccacactgagcatgtgatctgtgcccagattaatccccacaaccacacaattccattttatagatgtgaaggctgggtgcagagggatgaagtaactggcccaccccaagttcagaacccaaaactcatagccctcttggggccacacacagcatgatgggcttctaagtaccttggatttttaaaagccactttataaagtgcttttatgaaacaagatctcacctgacctggaaaaccagtgaggctgggactattcaactcattcgacagcagaataactgaagatggagaaacaggctatccggcaaatctgactggaactcccaggcccctcccttgaggagctgctgctgagagatggaagaactggcctcatctgtcctgctcatgatgcctcagatctgatccgcatctaacaggctggcaatgaagatacccagagaatagttcacatctatcatgcgtcacttctagacacagccatcagacgcatctcctcccctttctgcctgaccttaggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccatcggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaaggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttat

SEQ ID NO: 64251 - DNA, 7449 bp, Homo sapiens
ctagggacaaatgcagaaattcgtccgtgaattcgtcgtgtgaatgcagaaatatacacggatgtgcacacaactacagctctccacactgagcatgtgatctgtgcccagattaatccccacaaccacacaattccattttatagatgtgaaggctgggtgcagagggatgaagtaactggcccaccccaagttcagaacccaaaactcatagccctcttggggccacacacagcatgatgggcttctaagtaccttggatttttaaaagccactttataaagtgcttttatgaaacaagatctcacctgacctggaaaaccagtgaggctgggactattcaactcattcgacagcagaataactgaagatggagaaacaggctatccggcaaatctgactggaactcccaggcccctcccttgaggagctgctgctgagagatggaagaactggcctcatctgtcctgctcatgatgcctcagatctgatccgcatctaacaggctggcaatgaagatacccagagaatagttcacatctatcatgcgtcacttctagacacagccatcagacgcatctcctcccctttctgcctgaccttaggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccatcggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagtacccggaacccttgcgtttctttccccgtaaagggcctcccctccccaatggtgacacagaagtccacggtctggctgcagcccgtgacagccagcacaggagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaaggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttat

SEQ ID NO: 64252 - DNA, 7143 bp, Homo sapiens
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttaggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccatcggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaaggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttat

SEQ ID NO: 64253 - DNA, 612 bp, Homo sapiens
gttcctttctttctctctctctctttctttctatctgtcaacagggtctcactctgtcacccaggctggagtgcagtggcatgatcatagctcatggcagcctcaagcacctgaactcaagcagtcctcccacctcatcctcccaagaaactggggtactgcagacatccaccaccacatccagctaatttttcttaattttttgtagagacagggtcttactatgtttcccaggctggccttgaactcctagcctcaagtgatcctctctccccggccccccaaagcactgcaattacaagcatgagccactgcacctgccaactgttacttttattttgccttcttcctggaccccctcaggtcctcatgggaagtatgtggcagctgggttcaagcttgtctctgtccatctccttggcacagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtg

SEQ ID NO: 64254 - DNA, 369 bp, Homo sapiens
atattcccaggataattttggttttacttaagcatcactattgccctgaaatgtcaagtcaagtggaaaaataaatgcgaataatcccaccactagcctccagacttgatgtttatgttatttcctttttaaaatgacctttaaaaagttataaattagaaacgtggaaagtagaatggtttcatgcaagaaatactggaataagatccctgttctggccccaaagtcttagacaagtcattcagcctttctaagcgtcagttctcccatctggaaaatgtgggcattcatctctatgggagcttctagctctgtcagtgagtttctgaaacttgcccaggaaggagcagccctagtctgagtgcatgc

SEQ ID NO: 64255 - DNA, 327 bp, Homo sapiens
ccctttttcaaactcagatcaaattgtacattaacaaatatagtaacagcactgctagatttacacctcacagaaccccactgaatttatattcacatgaaaccttccaaagattgtcagctcacttcctcagaagcatgcaaccacagcaagactccaattacccccccaaaaaaaaagctcataaaacacacacttcagatcatttttgttaaatcagagaattagttacttgagaaagcacaacaaatattctcattgtaaatatgaaaaaaatagggacaattgcagggctactgggagtaatacaggagacttacataattt

SEQ ID NO: 64256 - DNA, 157 bp, Homo sapiens
gaaaagaaggaaggaaagaggggagggagggaggaaaggagagagggagggaaagaaggagaaaatgctggagcaaaggaggttggttacatgatttctctaatggcaatgagctgctttctggatgaaatacagaatcagagcgagactccgtctc

SEQ ID NO: 64257 - DNA, 196 bp, Homo sapiens
gatccacccacctctgcctcccaaagtgctgggatgacaagcatgagccaccgctccaggccaacaggagattgttttgaaaacatgggtgaagactgtgtgcccaaatccaccggcattggaggggtcagtgtgggcttggcacaagcccccatcaggaacgaatgggaatttaagagcacctggattttctgaa

SEQ ID NO: 64258 - DNA, 908 bp, Homo sapiens
tgtaattaggcaaatgctgttatttttaataaacaaatgattgtgaatacagactggtccagcaccatgcctggcacctcagtgttccctggagcctgcttcttaaagatcacagttttgcttatttgaggtgtgggacagcagccctactgcagaggtccttcacagggcagcagccagctgtgggtaggcatttccaggaagagcacaaggccttccttcctctctaccccagctgacagtttgctaagctatggagagtctgagtgggtagtgtaggagaaagagcatgaggtttgaagtcagaccaatagatagagattcaagaccctatctcagcactcacagttctaaagaccttttgtgaatcagataacatctttaaacctttgttttctcatctgtaaaatgggaataacaatgataatacctccttcagaattgcattaatatttgcataagattactgagaaatttcagtgaaatgataaaatgaccattgtttgttactgtgaacaacagtaacacttatataatactaaaagtaatgagaatctcttgcaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatca

SEQ ID NO: 64259 - DNA, 1709 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatca

SEQ ID NO: 64260 - DNA, 2910 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagagtcaccacgcccagcccacagatgtcacttctgcctttccattattactcagttttctgaatgccagttgcttctagcatagtgcctgctctagagaacccctcaggaaccaaggcctatctttctgtgttgttccactctacacctaagttgctgtgatggagccatgtggtcggggtcagggttcccactgcactttctgcagtgctcccagaactcagtatgtactgggaagggcctgctgtcgtgacagcctctctttggggccagcttctgcttttgcccccatctttgcagtacagggggtaaattaaacaagaggatgcctgaatgaacgatatcctgggttcttgagagacaagtgggagctgataattctgaaaattcattagtcaaagcatggagataaaggtggcagcaggaaggggagaggcaaggagtagacccgtgacagttttagaatcttatttgtgccaaaatactttactgcattggcttggacctctaatacaatgttgaattgttaaccatgatagcactgtatcctggtctaattcctgaattgaatggctagtcttaccattaagaatgctatttgcggccaggcacggtggctcacacctgtaaccccaccactttgggaggccaaggcaggtggatcacttgaggtcaggagtttgagaccagcctggccaacatggtgaaaccccgtctctactaaaaatagaaaaattagccgtgtgtggtggcgggcgcctgtaatcccagctgctctggagtctgaggcaagagaatcacctgaacctgggaggcagaggctgcggtgagccgagatcgcaccactgcactccagcctgggcaacagagcgagactccgtctcaaaaaaaagaatgctatttgctatgatttttggatgatatctttataatattaagggatgtcccttccttggattttgctttttaagggaaggtaatgtctaagataagcctttgaaatcttgaaattcagagtgatttgggatttatagagagctgtacagagcattggtgattgttattccttgagttcttaaaacgtaaaccaggcctgggcccttccttcctctgtgcccaactctcatcctctgtggtttgtggtttcagttattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaatttctgtcttgaagaatgataggagagatgatggggctctttttggcctgaagaggagaaggaatttattctttcattcagctctgagatcccagagttttctgaggcagagtccctgcctcacccaccagagatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaagg

SEQ ID NO: 64261 - DNA, 1214 bp, Homo sapiens
acagatgccttcctcttgtctcaactgcaagaggaatgccttcctcttatactaatcctcctcagcacagaccctttacgggtgtcgggctgggggacggtcaggtctttcccttcccatgaggccatatttcagactatcacatggggagaaaccttggacaatacctggctttcctaggcagaggtccctgcggccttccgcagtttttgtgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaatttctgtcttgaagaatgataggagagatgatggggctctttttggcctgaagaggagaaggaatttattctttcattcagctctgagatcccagagttttctgaggcagagtccctgcctcacccaccagagatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaagg

SEQ ID NO: 64262 - DNA, 1021 bp, Homo sapiens
  misc_feature (71)..(71): n is a, c, g, or t
attgtctctttaaaggacccgtatttaaataaaacaaattgggttgacgagtcgagacttgatcttgtctntggaaatggccaacaaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaatttctgtcttgaagaatgataggagagatgatggggctctttttggcctgaagaggagaaggaatttattctttcattcagctctgagatcccagagttttctgaggcagagtccctgcctcacccaccagagatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaagg

SEQ ID NO: 64263 - DNA, 1355 bp, Homo sapiens
tgtaattaggcaaatgctgttatttttaataaacaaatgattgtgaatacagactggtccagcaccatgcctggcacctcagtgttccctggagcctgcttcttaaagatcacagttttgcttatttgaggtgtgggacagcagccctactgcagaggtccttcacagggcagcagccagctgtgggtaggcatttccaggaagagcacaaggccttccttcctctctaccccagctgacagtttgctaagctatggagagtctgagtgggtagtgtaggagaaagagcatgaggtttgaagtcagaccaatagatagagattcaagaccctatctcagcactcacagttctaaagaccttttgtgaatcagataacatctttaaacctttgttttctcatctgtaaaatgggaataacaatgataatacctccttcagaattgcattaatatttgcataagattactgagaaatttcagtgaaatgataaaatgaccattgtttgttactgtgaacaacagtaacacttatataatactaaaagtaatgagaatctcttgcaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaatttctgtcttgaagaatgataggagagatgatggggctctttttggcctgaagaggagaaggaatttattctttcattcagctctgagatcccagagttttctgaggcagagtccctgcctcacccaccagagatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaagg

SEQ ID NO: 64264 - DNA, 1656 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaactgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatca

SEQ ID NO: 64265 - DNA, 1465 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaaccctccgtacacctcctaataaaacgggaccggctcat

SEQ ID NO: 64266 - DNA, 2463 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagagtcaccacgcccagcccacagatgtcacttctgcctttccattattactcagttttctgaatgccagttgcttctagcatagtgcctgctctagagaacccctcaggaaccaaggcctatctttctgtgttgttccactctacacctaagttgctgtgatggagccatgtggtcggggtcagggttcccactgcactttctgcagtgctcccagaactcagtatgtactgggaagggcctgctgtcgtgacagcctctctttggggccagcttctgcttttgcccccatctttgcagtacagggggtaaattaaacaagaggatgcctgaatgaacgatatcctgggttcttgagagacaagtgggagctgataattctgaaaattcattagtcaaagcatggagataaaggtggcagcaggaaggggagaggcaaggagtagacccgtgacagttttagaatcttatttgtgccaaaatactttactgcattggcttggacctctaatacaatgttgaattgttaaccatgatagcactgtatcctggtctaattcctgaattgaatggctagtcttaccattaagaatgctatttgcggccaggcacggtggctcacacctgtaaccccaccactttgggaggccaaggcaggtggatcacttgaggtcaggagtttgagaccagcctggccaacatggtgaaaccccgtctctactaaaaatagaaaaattagccgtgtgtggtggcgggcgcctgtaatcccagctgctctggagtctgaggcaagagaatcacctgaacctgggaggcagaggctgcggtgagccgagatcgcaccactgcactccagcctgggcaacagagcgagactccgtctcaaaaaaaagaatgctatttgctatgatttttggatgatatctttataatattaagggatgtcccttccttggattttgctttttaagggaaggtaatgtctaagataagcctttgaaatcttgaaattcagagtgatttgggatttatagagagctgtacagagcattggtgattgttattccttgagttcttaaaacgtaaaccaggcctgggcccttccttcctctgtgcccaactctcatcctctgtggtttgtggtttcagttattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatca

SEQ ID NO: 64267 - DNA, 1508 bp, Homo sapiens
ttcggctaggtagaggccgggtttagttgcttctagcatagtgcctgctctagagaacccctcaggaaccaaggcctatctttctgtgttgttccactctacacctaagttgctgtgatggagccatgtggtcggggtcagggttcccactgcactttctgcagtgctcccagaactcagtatgtactgggaagggcctgctgtcgtgacagcctctctttggggccagcttctgcttttgcccccatctttgcagtacagggggtaaattaaacaagaggatgcctgaatgaacgatatcctgggttcttgagagacaagtgggagctgataattctgaaaattcattagtcaaagcatggagataaaggtggcagcaggaaggggagaggcaaggagtagacccgtgacagttttagaatcttatttgtgccaaaatactttactgcattggcttggacctctaatacaatgttgaattgttaaccatgatagcactgtatcctggtctaattcctgaattgaatggctagtcttaccattaagaatgctatttgcggccaggcacggtggctcacacctgtaaccccaccactttgggaggccaaggcaggtggatcacttgaggtcaggagtttgagaccagcctggccaacatggtgaaaccccgtctctactaaaaatagaaaaattagccgtgtgtggtggcgggcgcctgtaatcccagctgctctggagtctgaggcaagagaatcacctgaacctgggaggcagaggctgcggtgagccgagatcgcaccactgcactccagcctgggcaacagagcgagactccgtctcaaaaaaaagaatgctatttgctatgatttttggatgatatctttataatattaagggatgtcccttccttggattttgctttttaagggaaggtaatgtctaagataagcctttgaaatcttgaaattcagagtgatttgggatttatagagagctgtacagagcattggtgattgttattccttgagttcttaaaacgtaaaccaggcctgggcccttccttcctctgtgcccaactctcatcctctgtggtttgtggtttcagttattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatca

SEQ ID NO: 64268 - DNA, 435 bp, Homo sapiens
gctcggtaccccttttagggtctttgctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatca

SEQ ID NO: 64269 - DNA, 488 bp, Homo sapiens
atgggccagactatggtggattccaagggagtcaaactctgtcctatccacaggaggacccatcctagtgggggatctgagaactgtagagccagataggtgtgtgaaaggtgcaggcacagtgtagggtcttgggaaaagccacctactcgcaacatgaaatatcaaagcaggtgcccacggagtttgcaaaggagaaactgagccgagagatatccagtgctttgcttgagaccctgaatgtcccttctggagttggagagtgggtgaaaagagccaggtctgggagggtgggcagcgagagttgactctgggtgttttctatccccatatttacttgacagcccagtctaggctggatgatgacccacctccttctacgctgctcaaagactaccagaatgtccctggaattgagaagtaagcaggaagaaacctattagaggatgcagggggccctgggaggattgtcgggagtggggaaagac

SEQ ID NO: 64270 - DNA, 2156 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaatttctgtcttgaagaatgataggagagatgatggggctctttttggcctgaagaggagaaggaatttattctttcattcagctctgagatcccagagttttctgaggcagagtccctgcctcacccaccagagatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaagg

SEQ ID NO: 64271 - DNA, 1143 bp, Homo sapiens
ggacgcgtgggtcgacccacgcgttcggcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaatttctgtcttgaagaatgataggagagatgatggggctctttttggcctgaagaggagaaggaatttattctttcattcagctctgagatcccagagttttctgaggcagagtccctgcctcacccaccagagatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaagg

SEQ ID NO: 64272 - DNA, 1783 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaatatgatctatcttctaatgtatccatgttgtaattatatatgtgtctgtgtgtgtcgaaatctctagacatacagatatatattcatatatcatatatatatatatacaca

SEQ ID NO: 64273 - DNA, 2451 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtgaggagctgagaaatgggacggcgggcgtagggaaacagggttcggcgaagatagggaataaggaagcacaggagtaggggagatatacagcggtcaggataagggggaaagggcggtggttgcgcaagaggtgaaacaagatgtgagagacaaggggtagggaagaaatggggcagcggttaggttcagaagcgcatagaccgtggcggacgggcaatgcgaggggcacagaaaggaactgaggggtgggctatttaaggagatggtcctcagccctctcttttctgcgtaggtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaatttctgtcttgaagaatgataggagagatgatggggctctttttggcctgaagaggagaaggaatttattctttcattcagctctgagatcccagagttttctgaggcagagtccctgcctcacccaccagagatacacacttatgacatgcctcccacacactcatacaaacaagtacctgtcatccaggtgatgtgtgtcagtggaggcaagacagagcatgtgacagcacagtggaagtgtggccggctgggtaggaagaactgctgtaggagctgccttctggactgggtcctaaaggatgagtaggaattcactatatagagacaggaagggaaggcctcctgggcagaagggattgcaagtacaaaggcaaggaagtctagagaggcatgctgtattcagagaacggggagaatgagaaataaagcttgaaagg

SEQ ID NO: 64274 - DNA, 1660 bp, Homo sapiens
actggcaagaggtttatttaccttttaagaagatttacattcatcgcaaagcagtagagaaagtattcacaattacaagttttctaaagtaaatgctctcagaaaagtgaggggaaggagtcttttccctttttgcgccagggaaaattaaattttctttttcttctaatttgtatccacccttacaccactcatttcacaaataacgtcaccgtaaagatttactaaatgctcactatataccaggtggtctgcatacaactcagttaatcctctcaacaacctaaaagagagatattgttattactatccctacagggcccacataggttaagtgacttgcccacaagatcacatgttgagtaaatggctgagttaggattccagaccaggactgtgcgattccaaactcagcgactttagtctccaggctacgaggctgccagagacatggctgaaacccagtagtagttcttacacggtcccatccttgtctaagggaggggtgaggtggggtggagaggggattgggttgggggtagaaggctaccgcaggcgccatggacctcccaaaataaccctggcccgagggccaggaatgagattaaggacggaacgcatgccctccaaaaagtggcattttagaatttatacagcaccccagcacgctgctaaacgtgggcacacaaccaccacggcccgatcacgcgcagcgggaacccggtctctgagctccgccccgtgcgttgcgtcatcagagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatca

SEQ ID NO: 64275 - DNA, 1183 bp, Homo sapiens
ctcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagctaggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggacccgaggctgagtacgaggcgaggcggcaggcagctcaggctggctgcgcagcgctgagtggcaccgccgccgctccccaggggcagggcccaccccacacccggctgactctcgctgcccttcctccttccctatcgggctctgcggtctggaggctggagagcggtgaggaccagggactgccctgtccatctcgggcgggtgccggcgtgggtggcggggcgcaggctgggaaagggagggcgcaagtaactggtgtgagaggcaggggttcagggatccttgctcttgagccacgatttccgatgagcccctgccgagagcatgccgctctggactcactcctcaaacataactgctctgctggaacgagagacttcaccaccctgtgcctcagtttcctcatctgaaagtgagtggaggggccttccctgcgagaagtcagagctgtgcccgtgggcaggctggctccgctgttctgctccaaggattacatgtccttcaaacgtccctgcccctgtaagtttcctccccacatccttccaccacttggggccaggcaagggcagagcttggagtcgagctgcagagaacggcttgaggtgtttggccaaagaactgcaggggtccaaccagaggctaatgtggcatgctgggtggggagagggcaacacggaagacccctgacgtctgcaagatgctccctgagaactgaaaatcgcactttggcccattcttctgtatcagcccttcccgaagtgtggatcggagttcctctgagggatgttaatgggatgacacacacccacacacaaataaaagactacatggccaag

SEQ ID NO: 64276 - DNA, 266 bp, Homo sapiens
aaaaaagatttcaaatctatctgacacagaggttcataacacttaattttgcagtagttgtttcctttccatttctttgtgggagaaatataaatgttaaacaggaaaaaaatactcaatgagagggtggcaggaatctttctaggaaccccttggtcagaccaaggtgttattttgagttaaggtagctatagtaaagaagggtatgtttccaaggcagacatagtatgtgccccagggagtcccttcatagctgtgtgagatag

SEQ ID NO: 64277 - DNA, 159 bp, Homo sapiens
aaggagaaagtgctgccggaaagtaatgtgagaagatggtataccaccatgtgtggcctaggacagtctgagaagactctcagggggctgtggcaggatttggggtgggcctaggggctgcagtatgaggctaggaggacaactgtacccctcatctcc

SEQ ID NO: 64278 - DNA, 2171 bp, Homo sapiens
tgctccccttccattaatgccaaatttattacttaaaagtaggatgaaaacagggagaataagagaaggtttacaatcttcattatcatatcgagaaaattatccgtgattttcctaactagcaatttgcctgccatgccgttcagaactgacttgcccattaattacagagatgaaaaatcatctggaattcggaaaagggaactaattccatggctggcagcgatcgcacccgtgcacggagccacatacatgtgcgacatacgtgtgcgctcacatgctataggtcccggccctcttgctggtcttgccaccatcttcctacccagcttggtgacctccctcatggccttgctcggtccaccccatgtgtgtgtggcacctgccctgggacacccctgcaggccctctttctctccaaggggcgcccatctcaatccccacttctgggaagcttgcgtaccccgtgatcacccacgctgattcctgctcttgggggtgtagctggcgcccagggttggggaggatggagagctggggaccagcacacctgggctgtggagcctgcagggagggggtggaagggggggacttgaagcccagcttctattcccagcctgcccaggggagccctttctcctggggggcctagtaggaccctgtgggcacgttggggaggagcctacaggcgcctcagctgcacgggagtgtgtttgcatccagcagtttgggcccccggccggtggcgtctccacctgcacgtgaggctgtgtgatgcttgcaggcatctcggtggggagggtggcagcgggtgcccctcaagaggaacaggaggagtgggagcactgccatccccgctggagcatcgtctttgccctccaccccctccttcctccctggcgagacatgtggccagggacacacaaggctctgggttctgtgtgggttcctctcacggatctgatttccacatgccagacacttccccttcttccagcccctccgtggggaggcagggagaggggctcccgaggcgggggttccctgggtctgaaaccctgaccccagtgaccctgaaggtgccatggcaagacagacagctcctcccaggctgggtttggggcaaagtggttgctattgggcaccctgatggaaggggagagacgggtcctggagtgaggtgggaggccaagtagaaacatggagggggtcccggtgtccccagaatccagatgtctgtctgtctctccacctgtgcataggtgtcctctgcctgtgtggcctggatggtgatctagccaagggtgcatgtggccacgtgaccatcaggcacatccggtgttcataagggtcccttgtgtgctggtgtttgtgttttgcagagggggtggtcatgctgggggaggtagggctgcaagaaggagtagctgtctgtgtgcacacatggagctgtctgcatcttttgtgcacctgcagttgtgtgctcaggatttcttggagcaaggctgggtgcaccttgtcatgcaatctgcacacacttgccaagtgccttccccacccagcaccatgcggggggtgccatgggggctggtggccacgtcctgtcctcatggagctcacactctagcaacacatatggggtttccatcaaagctctcctatcagctgggcgtggtggctcatacctgtaatcccagcactttgggaggctgaggtgggtggatcacctgaggtcaggagcttgagaccagcctggccaacatggtgaaaccccatctctactacaagtacagaaattaggcaggcatggtggtgtgcacctgtagtcccagctaccagggaggctgaggcaggaggattgcttgaattcaggaggcggaggttgcagcgagccgagattgtgccactgcactccagcgtgggcgacagagcaagactcattctcaaaaaaaaaaacccaaaacaaaaaagcaaaactctcctgtcatgcgagttggggagaaggcatgtgtctccttttcgagggtagccccaaattctgactgcagtagcccacaggcttggactgtcctggggtctggcccttcatggtctttctgggccacctcctccctcctcgttgctcctccagtgtgctaagtgtgatcctaccccggggcgtttgcactgct

SEQ ID NO: 64279 - DNA, 420 bp, Homo sapiens
atttttagtagagacagggtttcgccatgttggccaggttggtctcaaactcctgacctcagatgatccacccacctgggcctcccaaagtgctgggattacaggcctcagccatcgcgcccagctcagttttttttttaacaaaatataacaggaggaatatatcaagtacatgacatgtaataaatattttgtgtatcttttgtcatatgtattacacatacgtgtgtaatgggttacagtttacaatgaatttcttactgtggatcacatccagaagttttaaaagattggtagagaagccatattcacttgggtgtttctaaaatggaagcacagtgctggtgaatgatacacacttattttgtaattgagctgtatgcatttaatcataaataaataatctcatttatttaaatc

SEQ ID NO: 64280 - DNA, 452 bp, Homo sapiens
ataaatttacaggaattcataatccaggaacatgacctagaattgttagggtggatatgtcatgtgtttgtattgtgctatgattaaggcaatgatacagttgacaggaatcacaagtcaattgggcatcatctacctggaggtgggttttttttgctgctaagaaaatataaggattaaaaacaaattgtaaattgagtggtaatattttctacaagggtaacattaaaactgtgtttagcacaattactattattggatagtgtcccaatccaaatgctgccattcataaatgggagtgctgctttccatattgactcctgaattggacctctctttccttgataatgccattgaggcaaaggtgagctaaagcatgtgctgtgtcaagcaatttgggcagcagattgagattgaattgcaatgtgatgtagtgggagatgttaaagttt

SEQ ID NO: 64281 - DNA, 406 bp, Homo sapiens
gtaaaccctactgggccataaaacaaatctcaataaatttaaaatgatccaaattcatacaaatatattctcagaccacaatggaaataatgtaaaattagtaacagaaagatatttgaaaaaattccttaaatatttgaaaaccaattataacacacttctaaataacccatgggtcaaataaggaatcaaaaatggaaaataaaaagtagtttgaactaaatacaaatggatatacaacataatcagactttgtgagatgctgctaaagcagtactttgggggaaatttttagcactaaatgcttatattggaaatgaataaagatctctaattagtgacctcagcttccactctaagcaaccagaagataagtacaaattaaaactaagcagaaaaaaggaaa

SEQ ID NO: 64282 - DNA, 571 bp, Homo sapiens
ttttgtgggggcgtcgaccaaaagtagagtactctctgcccagcttctacagttaccaattttcaaagtctggtctatttgatttcatctagttcccgtcacgctgtcttttctgtactgattattttgaagcaaatctcagatgtcataacatttcgtctaaattggttctttatgtcagcttgatagcagtaagaagcagagaaaagttctgagcaagagagttacataaagaggtggagcttaatttcagagttccttttaagccagatcttcggctgggcatggtggctcacgcctgtaatcccagcacttggggaggccagggtgggtggatcacttgaggccaggagttcaagacctgcctggccaatatggtgaaaccctgtctctactaaaaaggcaaaaaattagccgagaatggtggtgcatgcctgtagttccagctactcgggaggctgagacatgagaatcgcttgaacccaggaggcggagattgcagtgagccgagatcatgccactgcactccagcctgagtgacagagcaagactctgtctccaaaaaaaaaga

SEQ ID NO: 64283 - DNA, 676 bp, Homo sapiens
atgaaatggtctttaatatttccacaataatcctgtgctatatttgttctaagaaacaaagtaactctatacacttcaagactttacaggattttttaaatcctgtattgttggatcaattaatagagatgcaaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaactttaaaaaaaagaatgaagat

SEQ ID NO: 64284 - DNA, 623 bp, Homo sapiens
atgaaatggtctttaatatttccacaataatcctgtgctatatttgttctaagaaacaaagtaactctatacacttcaagactttacaggattttttaaatcctgtattgttggatcaattaatagagatgcaaaaaaaactttatagagatgtaaaaacaaaactataatggatctcctatttttctttaaatacaaaaaaaaaaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaactttaaaaaaaagaatgaagat

SEQ ID NO: 64285 - DNA, 448 bp, Homo sapiens
gagatctggggctggaacattgtgttggaggacagatttgcttccgtatcctttaagtacatatcttttcctcttttccctaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64286 - DNA, 383 bp, Homo sapiens
gcaaaggacttgaagagctatttcttcaaagaagtttaaaaatggccatgaagcacataaagagatgctcaatgtcattagggaattgcaaatcaaaaccacaaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64287 - DNA, 1242 bp, Homo sapiens
gggcacgagggttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaaaaaaacaaggcaaaaaggggggccggccaaaaaatccccaaggg

SEQ ID NO: 64288 - DNA, 1172 bp, Homo sapiens
gggcacgagggttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtggctgatcctgttggctggcgaca

SEQ ID NO: 64289 - DNA, 1198 bp, Homo sapiens
gggcacgagggttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactttggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64290 - DNA, 1105 bp, Homo sapiens
tgcgtaaccatggtgatagctgactctagagggtaaacagacgaagcgagcgctggctttgactggcgaggcccgaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64291 - DNA, 1291 bp, Homo sapiens
gggcacgagggttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgttacctgtggcaaggtaagtataaggtgtccattctctttctaacgggcgacggagctgcggtgacagttgtcactggcacataggaactctatcttattacacccaccgggagaggagattcgctggctgcttcggagcacgacagtagcctgctggcggtgaggtacccgcggacggatgacagtgaggtctagtggctggcctgacgaccgagtctctggacaacagtcagcacaggaccatccttggcagggacgcagcgctgggtcccaggtggacaaccagagttgcgacggcacaccaacgtcacgggtggttaggtcgcatgacgcttcactagtgcgacgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64292 - DNA, 404 bp, Homo sapiens
gactctataggatcccccacgcacttgggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64293 - DNA, 1198 bp, Homo sapiens
gggcacgagggttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64294 - DNA, 1231 bp, Homo sapiens
gggcacgagggttctccctgagtgagactcacctgctcctctggcccctggtcctgtcctgttctccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaattaaaaatcgtctggtcatttggctccaaggac

SEQ ID NO: 64295 - DNA, 1569 bp, Homo sapiens
ccatcactttcactgctctttaagctcccccagcagagtggagaggtctgttttcccttgtttggattcctagaggcagcacaggccaaacacaaggtcatcactaaggaagtgtgcacaggatgaacgcggtgggtgctgtttaagggaagggtaaagcctttaaagggtaaagggctgagagaaggagcagagagtgtgtttggggtggaggcacccaggaggagtccgtgcaggctgcggtgctggacggatcctcctccagctcctgcttagaggtctccagaaccggctggaggcagggagggggtcccaaaagccttgggatcagaaggggttttcccgcctggtcccccagaccccccgttcgcctcaggaagacggaggatgagcctctgggctgcgcgtggtcggggttatggttgggatcagttaaggttccagtgccagcaccccgcccagggagccccggatggtggcgtctctgttagtgtcttccccggaggccgcccctgtgaccggatccttcgtgtccccacagcacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggtctgctctgtgagtggtttctatccaggcagcattgaagtcaggtggttccggaacggccaggaagagaaggctggggtggtgtccacaggcctgatccagaatggagactggaccttccagaccctggtgatgctggaaacagttcctcggagtggagaagtttacacctgccaagtggagcacccaagtgtgatgagccctctcacagtggaatggagagcacggtctgaatctgcacagagcaagatgctgagtggagtcgggggctttgtgctgggcctgctcttccttggggccgggttgttcatctacttcaggaatcagaaaggacactctggacttcagccaacaggattcctgagctgaagtgaagatgaccacattcaaggaaaaaccttctgccccagctttgcaggatgaaacacttccccgcttggctctcattcttccacaagagagacctttctccggacctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaa

SEQ ID NO: 64296 - DNA, 717 bp, Homo sapiens
tcgtgccgaattcggcacgagcggcacgagccagcatggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgagtccatcctgaggtgactgtgtatcctgccaagactcagcccctgcagcaccacaacctcctggttgctactggttcagcaactctgcagaaaatgtcctcccctgtggctgcctcagctcatgcctttggcctgaagtcccagcattgatggcagcccctcatcttccaagttttgtgctcccctttacctaacgcttcctgcctcccatgcatctgtactcctcctgtgccacaaacacattacattattaaatgtttctcaaacatggagttaaaaattaaaaatcgtctggtcatttggctccaaggac

SEQ ID NO: 64297 - DNA, 3705 bp, Homo sapiens
  misc_feature (21)..(21): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaacttt

SEQ ID NO: 64298 - DNA, 3062 bp, Homo sapiens
  misc_feature (21)..(21): n is a, c, g, or t
  misc_feature (1838)..(1838): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggtgccagatttgtttgcagactttgcctttatgtactttgcctgggctaatacagtttcttggaatgactaacactctggtggagagggagaagtgtctctgctctggctgtgactgagctcgaggtgctgtccagattagaaagactgtggagactcgaccggctggagtgtttcttttcattctgaggcgctgggaaacccttgcttctggggctaaataagggcctattttagagcagtctggtaggtatgtttgatgaggtacccttagtcttattcgagaaaatccacaaacccagaattacctctgataagagcttggcatcttcaacacgctccagaccagagagggccattggtatgcaggcagaggcctgntcaggccaacgttgccgtcaggttttgaggaataaggaagaaatatgcagtttctatttggtcattcaggattggtaacattccttcagtaattactacttgaaatcctaattttaaaagtatttgaaacctagattttttttccccttagaactttatgatagtcatgttcgcagatgaaaattctcaattttgggccttcatggcagcagggaggacaaaataaaatgaagactcccaaagggaaaaattgagcctatcctctgccagtttctactttgctgccccatttacattatttaaggtgtctgggatgggagacaacactaaaaagtattcactacagtagcagcacagggtccagtctttgatctctgaccccctgttttggggagcagttatgagatgagctagggtagattttccatggctgccattttacatgtggagcagcaaaagatgtttctttaatctttagataggaagagaaagaagaagccatctttagttgtatattttgccaaaagtgacttcaaaaataaataaattgttttggacatttagattttaaatttaaatttttttaaggaaaaattattttctaaatagaaaattaagcatgtagcatattgccaggcatatataggccccacaggtgcacattcactgcactgtgaggttaatcaggttcttggaactcccctccagtgccactcggcagtgattttagcagaagagtcactctacgggaatgtttgagtgccatgtgacgtccagagtgacgttctacatgacactcaacattttttgagccacctcataatttgagccgtgttgagagttaatagattgtttttgtgcaaagaattcgcaggtgaaatatgctatatgtattactgcagttttgtgggaagttgattatgacacagcagagactagatcacagagggaaccagataattctagaaatactagtcttagttatttagtgtttatagaatgagtgatattttgaataagggataattttggataattgaagccagtggttttttaaccaatgttatgtatcagaatcacctcacaaagcttctgaaaaatacaccacaaagtgtggctcacccaccacactttgggaggccgaggctggaggatcacttgaacccaggagtttatgaccagcctgagcaacatggtgaaacctcatctttaaaaaaaaaaaaa

SEQ ID NO: 64299 - DNA, 204 bp, Homo sapiens
ctgtttattgaacaccttctatgtgccaggcagtgtgccaaagatgtaatggcaaaagacataaaccttgttttcaagactcctaagtggaaatttatggagccaggcatggtggcccactcctgtaatcccagcactttgggaggccaaggcatgagaattgcttgagcccaggagttcaagaccagcctgggcaatatctac

SEQ ID NO: 64300 - DNA, 4828 bp, Homo sapiens
  misc_feature (21)..(21): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64301 - DNA, 4606 bp, Homo sapiens
aaactttatgtcataggtacgaggcctgggtgttatgctaatgacaacttcataaggcttgggagggcaccttcagaaaggttcaggatgaacctggcaagctacttctagagctgagtttgctactaataggcgctttctgagttacaaacataacaagtcatctgattttgaagaaactgaagcttggagtgtgaatgacgtgggttcagtaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64302 - DNA, 4223 bp, Homo sapiens
gtattttcctgttggtctggggcagagttcctccttcagaatattgagaggtcaggcagaaagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64303 - DNA, 4184 bp, Homo sapiens
  misc_feature (21)..(21): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64304 - DNA, 3701 bp, Homo sapiens
gaatcgagctcggtacctccagactgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64305 - DNA, 3480 bp, Homo sapiens
ggtacctgctacaacgctcctgcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64306 - DNA, 2803 bp, Homo sapiens
gactggctgctctagggatccccggatgctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64307 - DNA, 2881 bp, Homo sapiens
agttaaggtgtagagttcttactagttttctttttgcttgtttttttatacaaatagtgttgttatcagtttaaaataatgggttataatatagtgtttgcaagcctcatggtaacctcaagccaaaaaaaacatataatagatacacaaaaaataaaaagcaagaaactaaattgttattattattattatttgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64308 - DNA, 366 bp, Homo sapiens
ggagtgatatggacagatgttggttcagtgtcatgctaaatgtaacatcttaattgagccactgaaagtgtaatacctaaagcaaatatgtaggatatggctgttggttaattggattgattaaaatgggagccaaaggaggctttgtctttctattttacttgccttagatactgcttatatcggactgatttgttggagtttttccttattcctttttaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggac

SEQ ID NO: 64309 - DNA, 425 bp, Homo sapiens
attctattatctttattgaatgttaagaatgtttggcttttcctgtacttaagtatgactgtctctctctctttaatgtacttctactctaacacctgcttttctgtggatgggtttttgattggctagaaactggaggaagcagcatctcgtgcagcagaagaggaaaagaaacgccttcagactcaagtggaacttcaggccaggttcagcacagagctggaaagagagaagcttgtgagtatcacatggctggagaaagcagctgcagtagctcagcctgggtcggtgggaacagggaagggctggaggctacagtgaggcatgtcatcagcttggctttgctactgacctggaatgggctgtaggggaagttgcatgtttgttcattcattaattatctgtttattgaacaccttctatgt

SEQ ID NO: 64310 - DNA, 4905 bp, Homo sapiens
  misc_feature (21)..(21): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64311 - DNA, 1031 bp, Homo sapiens
  misc_feature (21)..(21): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttggcctgacaaagatggaagaaactggcttttctcgtacactgtctgatcagacttggactcaggcttccgataagaggagaaccgggtggttcaagccattcattctactatcatctgtgagcgggcgcctccacacaaaagagccgcacgtcgagatcggagagcgtggggacaaggacgggggcaggggccgggccgagacgggcgcccgggaaggggcggctcggcaagagacccaccggccgcaccggagagacacacgggggccacgcaaggggaacaccaccgccggcgtcaagcacggcgc

SEQ ID NO: 64312 - DNA, 4863 bp, Homo sapiens
  misc_feature (21)..(21): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaac

SEQ ID NO: 64313 - DNA, 4731 bp, Homo sapiens
  misc_feature (21)..(21): n is a, c, g, or t
aggtgacggcgcggcgggctntggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64314 - DNA, 4613 bp, Homo sapiens
aagaacatttaaatacctgaaatctcacacataaactataatgtattttagtgaataataatgtcttgagatgtgtgatgcccatgaaggagtctgcttagatttaactaaacatggagatctacaaggttaccaaaggccagtttactcataaacatataggacagaaaccacgggttgccagccacaacattccaagtgcaagaagagaaagccacattaagcagatgtaggaatcaccctggcttaggtgcttcatatcccataggagttaatacctcttgtaacatcatcacagatgtaccttccaggattcctgcaagggaggtgctcaggataagagctgctatactcaggaaatcccaatgcatggcatcctatcaggtgtttatagttttaccagtctagatgtagtataccaactggggtcatttttaccataagtaatgtgcttaggaaacagcatttgtaaatcagtaatatgaatttataggtatttttcattgacattaagtttcagctcatttttataaataattcaaattgaatttcatttaaatacttaaaattttgaggaactaatttggctttctgttttagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaatgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64315 - DNA, 3632 bp, Homo sapiens
agataagcttctctgacagcagatgtccagagcacggttgtctgaaagctcctctggaattcgcatacaagtttaactgcgagctatggaagcttggaacaggtcgccgtatgctgcgtcagtgctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64316 - DNA, 3657 bp, Homo sapiens
gaaatagagataagcgttctcacacacccgatagagaagacaggttgcatcgagtaggcttgcgttatcggtcattaaatattcatagtcagtaccccatctgcgttacttgtgactcatcttgctagtggctctttagtattataccttcgtgcctgtcgaccagtagaataggatggatgcagatgcttcatcggcaggtgtgtggtgaggaatcatctgcacagagatctgtgagctatcatggaggtggcattctgtctacagtcgaactgcatgccgtacaaccgaggcggagaagcaggagttggagaatcagcgtgtcctgaaggaacaggccctgcaggaggccatggagcagctggaggagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagaccagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattattggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagacaaacgagacttaggtaaggaatggaacctttcctgtggtttgactgcacatcacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 64317 - DNA, 464 bp, Homo sapiens
gcgaccccagcctggccaatcagacacagtgactggtcagcatgtgacctggtgtggccaatgagaaccagcccccaaagaccactgctgcaactccggggaaattggcaaactttctccactggggaggacaggctgctggggtgtaagcctggagctgcaagtctccgctaccttaggaggagaccctgaaaggtaatgaagccaactcggagaaaataaaaagagaccattcatgatgacatcatctgacaactagatgcagccatgccttaagactctaaactcttcaattacatggcccagtaaattccctgttttgttttcccagcttgaattgggcttccatctctcacgactcaaagaaaactgacaaatacctccttcagctactgagaaattgtcaacaatcctccctcatcaacatgataatcaccaaactcccacctctgccatgcaaaggc

SEQ ID NO: 64318 - DNA, 247 bp, Homo sapiens
aattcttcacttaaatctttgcgtctttaagattcgtgaacagagcatattttcttgcccttcaaaggactttatgttagccacttctagtatgccatatcccagtgggacgtgagtctttctgccccttcctttcagccttggtggtgatttacaaggataaacacttgagcactcaacatacttatgtttattagtacacgtaaatggttaattctacactgacaggcacatattaaattggttc

SEQ ID NO: 64319 - DNA, 343 bp, Homo sapiens
ccgtcttagctttctgtatgtcaccatatccatcttatttctttaatttatttttcgaagagatggaatctcactatgttgcttaggctaccaatagatttttaaaagaattttaagcggaaaatttgagttatgtttgaataccattaatttattattttgtccattcatttatgaaactcttgtttgtcaagtactatggtcatgcccaatgctaagcatgcaaaatacaaacataaattacatgctcttcattttctcaaaagactcataatctagcgcaatagtcatgtaaacatactcacttcattttatgaatgtaccacagagttatttattaaaa

SEQ ID NO: 64320 - DNA, 412 bp, Homo sapiens
tactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtaaatgcagaacatttaatattccacaatatatatggttttttattt

SEQ ID NO: 64321 - DNA, 419 bp, Homo sapiens
  misc_feature (27)..(27): n is a, c, g, or t
tgctggactcctgagccaggaggtctnttcactccgtggcccttctgctcattcttcaagtccctgaaattcatgttgaaccataatccacaatgcaacagtatcaagaggtgtggcctttaggagctgattaggccacgaaggctctgcctcatggatgggatcacccttataaaaagacttgatggagtgcattcagtcccttttttgctccttccattccttccaccttgtgggaatacagcatgccctctggaagatgcagcaacacagcaccattttggatgcagagaccacattcttgcaagacaccaaacctgctaatgccttgattttggacttccagcctccagaactataagaaatatatttctgttctttataaatgacccagtctcaggtattttgttactgccata

SEQ ID NO: 64322 - DNA, 758 bp, Homo sapiens
ctgtcacattttattagttaatactagctgtcataactgataatccttggtaactcaaactcagcttaataaaataaaagtacatttcttgctcatgtaaagcccaacttgaagtagattgaatgaccctgctccatacagtcattcagggacccagcctgcagaggttctgccatcttcaacctgtgtcttctttagttaacttactgccaatctccagccaggagacagaggagagggaaggcgtggagggttccaaaagggcctttttggccggagctcattctgttgtctgctacatttagacaactggaggggttggggcaagaaatgtagatccttgctggtctcatcccagcaataattttgcatattgaaaggagtgcacaaatctttgaacagctggccatctctgccttatggacaaaatgccatttgttttctgttcacatgtgggtctttcatgacctgtgagctccttggggtcaaaggctatatattattcaattctgttatccctagttcctagtatagtacagcaggtaaatagatgttttctgaattgaaagtaaaaaaaatcgtttttctgttggatgtcgggcaccataatagatgcttacatttttttttttggataaaggaggtttttttttaaaaaaaggaaagaataaaagaagaagaaaccatttgctataataaagatctgcaaagcatggtaccgggttccaggatggtaggtgttcaagaaacacatattg

SEQ ID NO: 64323 - DNA, 387 bp, Homo sapiens
aaaataattaaaaggtgctacctgataacttttagggagagtaaaacttttgctgactctcttttatcccagtagtatattagtaactatatttatctcccctattagctttgagaagtctatcgagtctttatgctcgaagagtgtaatttaggaggtatgctgcatgaacttgcggtaaaaagaagtaagggaacttcaggaatgccatagttctctcttacattcctgaaaattaaagttttgtatactgctcctaatggtaaaatcctcgacctggtctgatacaggcttagtctcccaaaagtgtaaatgtgtttgcccgtgcaccactggagaacaaatccttcaggtaagtgagtgtcttccgtgaaagcaaagtgctac

SEQ ID NO: 64324 - DNA, 106 bp, Homo sapiens
tttgagggtcccacataatgattttaattattttttgttaatttattccaacatttaaaattcatgataattcacataaaaacccagattatcatcctcttgaaaa

SEQ ID NO: 64325 - DNA, 454 bp, Homo sapiens
caatgaacgccaaacgaacttgagaagtggttgctgaaaggcgctgatgtttccacgtgagatttctgggtcaccctcctggtgactcttgtgcctctgacttctatctgatcctaagtccctgtgcattaaaatacaagcaattggctggatgcggtggctcatgcctgtaaccccagcactttgggaggcccaggcgagtggattacctgaggtcaggagtttgagaccagcctggccaacatggtgaaactctgtctctactaaaaatacaaaaattaactgggcgtggtggcaggtgcctgtaatctcagctactcgggaggctgaggcaggagaattgctggaccccaggaggcggaggttgcagtgagccaagatcatgccattgcactccagctcggtgacaatagccagaccccgtctcaacaacaacaacaacagcaacaacaat

SEQ ID NO: 64326 - DNA, 1656 bp, Homo sapiens
ttcagactcctgcagaaggaggccgggtgccatcaggagtccccgtttggtgtggccgccttctctttggtgtgagtgtcgtcctctctggctgggttcttattttctacatgtagctcaggcgtaagctggtgcccacccgtgttaagtgtcaggctggtcctgaagcagcccagtgcctacagtgaggaaggacctgccgggcaaagcagggcgctcatcaggccagggtttctagaaccatatcccaggctgctgagaatgggtgtgtgggttgtgtgatgcagaattctaggagatgtcatttccatcatagtctagggaaacactcgagcctcgtggagggagatggttctggagggaggcttctgtagcatccaagcccaaggtgagcaggagccccctgagccgagctgctgggactgaagaggaaaaggagagagtgggagtgagatgctaggaggcagcgctgatggcgcttggggacttgactgagaggagtgggacatggagtgggtttccgggtgggtgctcctgtgactcctctagatgggggagacaggagaaaatgtggaaggggtaaggaaagagtgtacagggatgggctgaaggccacagcccttctcggcccctggggagatgttgggaggtgactggatacacccagtgactggtctgaagcttgggaacaagttagggctggaaaaacagacttgggcatcaccgctgtatttggagctggaaataggcccagattaggaacctgggcttgtgaggactggattcccagcgaaggtggaattgggcctgccagccatttgtatacttttctgaagagcatggaattaaatagcattgggcaggttggcactgggggaaagaagaaccgggcgaggttaggacgtggccttgctggcatgataaaaagcatgaggaaacgctttttacctcagaccacacgtgaattgcaagcagctgccctgatggtgccatcaggggcggtggagatacaggccgctctcctcagccatttcctttagaccaagagagcttttattgtgtagcagatgaaagacccgatgagaatttgaggtgtatagtataatgtaaagtttggaaataatgattgtacttgttaattctgtattggtctttggaatcaagggtttctgaacctgagataagcagcttttttgtttcataaaagctctagtcatttttctgtgttgaaagtggaccacagtaatgttcatggatttgttggctgaagcacttccatgtggcttagaagcttagcagacacggcacctccgcctttgtgaactgtcattggccactctgcaaatcctggtggtgcagtagtttagaactgtgtagaaaagatctggttgtagaggacaggaggctgatccagaggcgtctagtcacttgcctgaatcacagctaaaaagcagcagacagaatgaggactcacagctcctgatttattttttccttttgtttaaagcccagtgtattgaactgggcagtcagcatggtatttactgttttatattgtccaggtaagaaacctggagcttattgggagcagaattacaaatataagcaatgccaaccttccctgcaccttagcattacctttaatagtgtcaaaaa

SEQ ID NO: 64327 - DNA, 294 bp, Homo sapiens
aaaattataatgttacagtaatcaaaacagtgttgaattggtatagacaaaccgatgatggaacaaacagagaactcagaaacaggcccacacgtatatgaacaactgatttttgacaattgtacaaaggtaatttaggtggagaaaaaagagtcttctcaaaaaagggttctagaaccatttctacatgcaagaagcttatatccagaatactaaaatataaaataaaaatgcactaccaaaactcaataagaaagcaactcaattaactaatgaagcaaagatttcaagaga

SEQ ID NO: 64328 - DNA, 811 bp, Homo sapiens
cgaacaaggcctcaggtacatggcatgtggccatgatctgataatgcagtcttttccattgcaactagaaaacagtattggaaacagtttgtattcatatggacagacagcaagattaatgtacagtactgcctcaaggttacattacttcacccaccctctgttatgatatccaaataacatctggaccacctcacagcgtgttacactgatccacttcatttgattgtgtcatggtgaatggacaggtggagcaagcattagctaggagactgaagatgctccagaggatgggagatagattgcaggaatattcagtaaaggttttagtggtcaagttcaggagtcttgacaggatactccttccaaaatgtcacctgcatcttgcatcacctaccataaagtaggtagcatggcacctggatggcctctttgacttctaaaatcaagacattccacatctaggaatattgttccagatatattgtcacccggtgacacagaaagctgacatctctgagtaaggctcacaacaaaaagggcatggcagcaggcataaggcacagtacaatcatccctgacactacagctgggtgaccagcagatcctgtggagttggaagcgtcagtgatgggaaaaagtggaaaaagggaaaagctataggaaaaggaatatggagcttgtggcaaatccaagtggagaaatcacaatgcaaacccccaggattctgaaggaaagccattccattcacagcaagataattttgtgcccttttaaaatcagctcttgacttactggactctaatagcat

SEQ ID NO: 64329 - DNA, 228 bp, Homo sapiens
caaagctgaggcgttgcaacagagatcatatggcccataaaaagtaaacagctatttactatctgggccttaacagaaaaagtttctgccagcctctgatttagatgcttgaagaaattcagttttaaaatagggctgggcacagtggctcacacctgtaatcccagcattttgggaggccaaggccaaggtgggtggatcacctgaggtcaagagttcaggaccagc

SEQ ID NO: 64330 - DNA, 468 bp, Homo sapiens
gtgtttttaaaattgctttaaaaattcagcatattgtagacctcttttatgccagtaaaaaaataacttctcaaagtaactacatagaattctgttttatggattaatcatactttatttggccaatttcccaataatgaatttttttcctccagtttttccttataaattgtgctgtgatggccaggcgaagtggctcatgcctgtgatcccagcactttgggaggctgaggtgggcggatcatgaggtcaggaggttgagaccatcctggctaacatggtgacaccctgtctctgctaaaaatacaaaaaattggctgggtgtggtggcacgctgctgtagtcccagctactcaggaggctgaggcaggagaatcgcttgaacccggggaggtggaagttgcagtgagccgcgatcacgccactgcactctagcctgggtgacagagcaagactctgtttcaaaaa

SEQ ID NO: 64331 - DNA, 350 bp, Homo sapiens
gtcaaataaggggactatttaacagagctgtgggcaggattaaagaacaaccaaagatagtgacgcaccagaaactagcaacatcagaaagcctttcctatgcttaagtctgaaggagaaattcgaggaaacggttgttaaatcaggtaccagaacgtttatgttttagaataactcagggagtacaatgggaatgtccatggcacaaagaaatgatgagtgcttgaggtgatgagccccatttatcctggtgtgattattatatgcttgtatcaaaatatctcatgtgccccataaatatatacacctactatgtatccataaaaattcaaaattaaaacaattttaaa

SEQ ID NO: 64332 - DNA, 285 bp, Homo sapiens
tttgtggtttcctgccactgttttggcatgcttgttgttgagattgagaaatagtagtgtatattatatttggcaattatgcttataatctgaaagtgtttgtgtaagcttaggaggtgtaaactttttacttcgcaaacagggaaacagagatccaggcagggccaggggtgttttgggtgagatcaccaaaggcccagaaataaagagtagaatccatgacatctcaactccagaagtactttccgtgcctctgaaacatgatgcttcacttacttaggtttt

SEQ ID NO: 64333 - DNA, 310 bp, Homo sapiens
agtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcaggtaagtatgg

SEQ ID NO: 64334 - DNA, 1333 bp, Homo sapiens
gcctctgggactcaattcgcctctaaaaccctgccaggttctagataccagctccagaccacagccccagacagctctggtattcaactggactttgggaagcagagcagttctgaaagtcagcttagctttggaactcagcccagctctgggacccagataagctcaagaattcaagccagctctggaagtcagcttagttcgggaacccagctgatttccggagcccaacccagctccagaactcagactagttctggaaaccagctcagctccgggacccagaccactgcaagaattcagctcagccctggagctcatcttagctccagaacccagtccagtcctgagaccaggctcagctctgaggctcagtccagctctggaacccagttcagttctgggattcagtttggctctgaaacccagaccggctcaagaattcagcccgactctggagcccaacttagttccagaacccagtccagctctgagaccgggctcagctctgaaacccagaccggctcaagaattcagcccagccctggagcccaccttagttctggaacccagcctgtttctggaacccaatccagttccagaactcacaccagttcaagaatctggctgagccctggaaatggaatctgcccacagacccctggccttgaccctagaatccagcttgaggcccctgccccagcccaacctcagcccccaggcccatcccccagagaccccaccccagcccctagcaaagacccccagcctctgcctcagccccatgatcaggtatgtggcatccaggccagccttggccccatcccaggcttaccccaagcctcctacctggccccacagtcacaggtctcctcaaccccccagaagccagccgtctctcccaagccccgggtgggaccccagaagtccaccccacccaccatatctgtcactcctagtcctgcccctagggcagccctcctgagttcccagctgtctgagtccccagctttggcgccagccctttgccccactctgggggagccaggagcccgcccttaccgcggggggccgtagcttggctgtgacttagccctggttcatgtggttctcgtcctctcctgtcccttccagcctggggcccccagaagcagcaagtgaccttatttctccagcaggcggtggtagggagtgtgcggtggtgaaaacaggggcttcaccggtcctggctcagatccaggtccttggagggaaaaggagggcaggagacgggttgcaccgcatgtaccctgagggctcatggtgaataaaggcaccttccatctctgcagcc

SEQ ID NO: 64335 - DNA, 633 bp, Homo sapiens
taatatagatccggcaagagcttagctgtgatcactcctagctgctcagcaaaccactgaggttcctgggaaaaaaaaaaaaatatctcaagggtgtgttaacttgggacactcgttaactgggggaccttcttgaggcttttttccttctttttaaaaatcatctttgattattcttcttttctagtaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaa

SEQ ID NO: 64336 - DNA, 789 bp, Homo sapiens
taatatagatccggcaagagcttagctgtgatcactcctagctgctcagcaaaccactgaggttcctgggaaaaaaaaaaaaatatctcaaggtaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaggacgcttgaggaattagaaaccggtattacaattttggcccagttttttaaaagaaagcgctcaatatgaattagtggccattacaggaggactccccagagggccagccaggcattatccccaagaaaaccgtttgaccacagatgcacgaaaagaacgaagatgctgcatgattgaccgcccgaaagggagaagatgctggctgacgaaggttgacgaccgccaccggaacgaggaaggcacagcgcaggacacaacttgaactggtgcggcaccctcgccccggtgatggcccaacattcaggaacggggacgaccgggccagaaaaaaaaaatttctcgggaagttttcacaatggtcgc

SEQ ID NO: 64337 - DNA, 791 bp, Homo sapiens
  misc_feature (446)..(446): n is a, c, g, or t
  misc_feature (460)..(460): n is a, c, g, or t
accacgccctccacgtgttccactgcctcttctcttctcgcttgggaactccagtctcacctcggcttgcaatggaccccaactgctcctgcgaggctggtggctcctgcgcctgcgccggctcctgcaagtgcaaaaagtgcaaatgcacctcctgcaagaagagctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccaggattttttttttctacaactccgactcatttgctacattcctttttttctgtgaaatatgtgaataataattaaacacttagacttgaaaaaaaaaaaacaaaaacaaaaaaaaaaacaaaaaaaaagaacaaaaanaaaaaaaggggggngggccctgagctccaacaatgaatatcattcccatctcccgataaggggaagcggtgggaccacccgcaccatcatggataaccgaacgtctgcatcgccacaaacgtgatattatcccttagtctgacaagacaccaaagagggggcgcgcccacctatgatatgagtattgggcggcggacgcctaaattatagtaaatcaaatgacaacaaggcgtgaagcgcgcaggcgcagaaggacatatcaaaagaaagagtaaggattcgaggaccaccgcttatattggcagaaaaacagaaacggcaaagataagcaatgcgcaacggaac

SEQ ID NO: 64338 - DNA, 1710 bp, Homo sapiens
  misc_feature (1365)..(1365): n is a, c, g, or t
  misc_feature (1379)..(1379): n is a, c, g, or t
accacgccctccacgtgttccactgcctcttctcttctcgcttgggaactccagtctcacctcggcttgcaatggaccccaactgctcctgcgaggctggtaaggaacgcccgggttctgtgccttaggatgccaaattcccagacaccatagagagtgtccctgggtttgaggaggtcatattttgcgatctgagctgaagaggacttctttacttcctccgctgctttcctcttggccaagctcctgagagcatgtccctcttccctgtgcctctatgtcagagttgagggtcctaaggctcaaggctgtcctgctccacatcaccccgttggtcacgaggctgctggctgagccccaattctctaaccaggctctgagcagccggattggatgggaggcattggataggtggggacattgcctcttcagggttcagcacagaaagtcgaagtcgcagtcttcccgggctgtgcctggagcctgggacttacctttggaatacaaacggagggtgcttggttttcccagcatgaatggagaggagatgggtcttctcttcttctgctgagtgggaaaggagctctgacggctggccctgaacagagaagggggaagtggacactcattgacccactgctgtaacttctgcatctcactcacaacacactggctttttctattccttgcaggtggctcctgcgcctgcgccggctcctgcaagtgcaaaaagtgcaaatgcacctcctgcaagaagagtgagtgcggggccatctccaggaatctggggctgtggctaaggttgggagggaacccaaggctggccctgagtgcctgcttcctttgtccccctaggccgtcactgcctttccagtcttctgctctgtccagggctcctgtggggctgggcagtctctcataggaagactcaccccaatatccaccagtcgtctcctgaaaaagctgtgccatcctgaactaaggatcctctggggctggagtctgagcttgagccaggcctgctgttgggagagggagctccctggtcaagtctgctgtgacttctctctccctttttccccaggctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccaggattttttttttctacaactccgactcatttgctacattcctttttttctgtgaaatatgtgaataataattaaacacttagacttgaaaaaaaaaaaacaaaaacaaaaaaaaaaacaaaaaaaaagaacaaaaanaaaaaaaggggggngggccctgagctccaacaatgaatatcattcccatctcccgataaggggaagcggtgggaccacccgcaccatcatggataaccgaacgtctgcatcgccacaaacgtgatattatcccttagtctgacaagacaccaaagagggggcgcgcccacctatgatatgagtattgggcggcggacgcctaaattatagtaaatcaaatgacaacaaggcgtgaagcgcgcaggcgcagaaggacatatcaaaagaaagagtaaggattcgaggaccaccgcttatattggcagaaaaacagaaacggcaaagataagcaatgcgcaacggaac

SEQ ID NO: 64339 - DNA, 1117 bp, Homo sapiens
  misc_feature (772)..(772): n is a, c, g, or t
  misc_feature (786)..(786): n is a, c, g, or t
accacgccctccacgtgttccactgcctcttctcttctcgcttgggaactccagtctcacctcggcttgcaatggaccccaactgctcctgcgaggctggtggctcctgcgcctgcgccggctcctgcaagtgcaaaaagtgcaaatgcacctcctgcaagaagagtgagtgcggggccatctccaggaatctggggctgtggctaaggttgggagggaacccaaggctggccctgagtgcctgcttcctttgtccccctaggccgtcactgcctttccagtcttctgctctgtccagggctcctgtggggctgggcagtctctcataggaagactcaccccaatatccaccagtcgtctcctgaaaaagctgtgccatcctgaactaaggatcctctggggctggagtctgagcttgagccaggcctgctgttgggagagggagctccctggtcaagtctgctgtgacttctctctccctttttccccaggctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccaggattttttttttctacaactccgactcatttgctacattcctttttttctgtgaaatatgtgaataataattaaacacttagacttgaaaaaaaaaaaacaaaaacaaaaaaaaaaacaaaaaaaaagaacaaaaanaaaaaaaggggggngggccctgagctccaacaatgaatatcattcccatctcccgataaggggaagcggtgggaccacccgcaccatcatggataaccgaacgtctgcatcgccacaaacgtgatattatcccttagtctgacaagacaccaaagagggggcgcgcccacctatgatatgagtattgggcggcggacgcctaaattatagtaaatcaaatgacaacaaggcgtgaagcgcgcaggcgcagaaggacatatcaaaagaaagagtaaggattcgaggaccaccgcttatattggcagaaaaacagaaacggcaaagataagcaatgcgcaacggaac

SEQ ID NO: 64340 - DNA, 451 bp, Homo sapiens
gcttgaacccaggaggtggaagtggccgtaagccaagatcgtgccattgcattccagcttgggcgacaagagtgaaactccatctaaaaaacaacaacaacaaaattaaatggggagccgggcccggtggttcacacctataatctcagcacttcgggaggctgaggcaggcagatcccttgagtccaggagtttgagaccagcctgggcaatgtggcgaaaccccgtctctacaaaaaatatgaaaattagccaaatgtggtgacatgcacttgtagtcccagctactcaggaggctgaggtgggaggatcacttgagcctgggaagtcaaggctgcagtgagccatgagcgtgcaaccgtatgtactccagcatgggtgacagagcgagaccctgtctcataaaaataactaaataaatacatgcaaacaaaatttttaacatacccca

SEQ ID NO: 64341 - DNA, 398 bp, Homo sapiens
tctaatggaatctagatctttgtattcctgcatgtaaatggatattaaaatacatactctatgcacactagtagtagctatcacacatatgcatttatattaaaaatactaataacggtcgggcgtggtggctcacgcctgtaatcccagcactttgggaggccaaggcagatggatcacttgaggtcaggagttcaagaccagcctagccaacatagtgaaaccccatctctactaaaaatacaaaaattagccaggcgtgatggtgcacgcctgaaatcccagctactcaggagtctgaggcgcaagaatcacttgcagctgggaggcggaggaggcagtgagccagtatcacatactgtactccaccctgggcgacagacggcgactccatctcg

SEQ ID NO: 64342 - DNA, 424 bp, Homo sapiens
tgcaaaggtgaacagtatgacttaaggtaagttgaaattcactagtgtctgtggaggttgacccgaaattttggtgcttaatttatttatccatttcatgagcagaagtgacacattttcttatttcattttaatgccattgtacatctttaaaagacagtttctcggcacagcatcaataatacaagttataatgattttttttcttaaagtatcttcaagataatatataggttgccagagttgtcacatctcacatactgagccaggctatatttagtatttcatctgagacgtaataaaattttcttctatcttaatcatagaaaaaatatattgtatcatcaactatatgattagctagttgccttttggacatatttaggatgaaataaatgttcatgaaattttatttgttgaattt

SEQ ID NO: 64343 - DNA, 534 bp, Homo sapiens
gtagactcaaagaagtgaagaatttaaaaagattggtaaaatatggtgattaggccagctgtgcctgttagctgacactgtgactggggaatagataccctatttttcctgatggttacatttttaaaggaatggctttcaggtccttgagaaagacactcctgagttgtaggagtacagctcaaagggacagaggaaggattcacagttgtaagccctttttagtaaatgatctaagaggatagttagggcctatcttcagatgctggctagaacaaacagtagattctttggcagccttgagctttaagaggcagacaatttgagagaggctagggtcatcctagggaggtaaccttgagctgttagaaatgttagtatttaaaattagctggatgtggtggtgtgcacctgtagtcccagctactccggaggctgaggcaggagaattgcttgaacctgggaggcagaggtgcagtgagctgagattgcgccactgcactccatcctggtaacagagtgagactccgtctc

SEQ ID NO: 64344 - DNA, 192 bp, Homo sapiens
cttatgcacgtagtctgaaggtaattttacttttcccttggagatgctgaataaactgcattgtgcacctgcattttgactgcaacctgtcacatgaagttgggtatggaatcttctacttttgacatcatgtcagggctcaaaaagttttggattttggagcattttggatttgggatttttgaattagga

SEQ ID NO: 64345 - DNA, 275 bp, Homo sapiens
gggagaaccgggtggttcagttctctgtccccggggagctgtcctgctggggcaggtgatggaatctgccacattttcagtgtttttgccgcgtgtctgtaaccagcatctaagtgtgcaggggttactttggaaccctgagaattgtatttagctccaggcctcaggattttgctataactttgtagtagctgcattacacatcccacaaattcttttggcctataaaatatataattatagatcctgaggaacttggcttaatatattattga

SEQ ID NO: 64346 - DNA, 712 bp, Homo sapiens
gacccatccagttctctgagggggctcttgtgtgttctacaaggttgttcatggtgtatattacatggttaacatcaaaaggctgcctaataggcacctcttcaatataatagtcttttaattagtgaaaattttacacagttcatcattgcttgcttgccttcctcccttctgtccgctcttactccctccttcttttattttctacttacttttccaaaatcatttaacccctttttgtaccattaataagttatcttgtttttgttgttgttttccttttaacaatatgcactgaataattcatctttgtgccaatcgtaaatattttgatataacaaagacttctgtcataaatagatttcctgtgagtaatcttgcaaatattttagaacctgtttggttaagaataaattaaaataaatagacaaatttttaaagacatacaacctatcaaaactgaaccaccaagaaataaaaaatctgggctgggaaaaaaaaaaccaaaacaaaaaacaaacatttggtcggcgccggcctttgggcccttgaaaaagaggttttctataacccattccggttgggcggcgccggggcgcgcattatgggtacgtgtaaccacttgggccataacgcgtggtccctaaggagaaactccggcgcacaaagacatacgtccgctgggtttctccccaaattaaaaaacgccgag

SEQ ID NO: 64347 - DNA, 2138 bp, Homo sapiens
taactgcagaatgtacgctgtcttcagttaaggctgagagtgggaaggagttcctaatcagagatgacatggagatcccttaaagagaaccagattcatacacaaaatgtaagataatttattggctataaaatataaatgatggtatttctgaaaggttagcaatgcatgcctgtctcgtttccctctttctctctctctctctgatagtcacttcaatcaaatggaaccaggaaatgatacacaaatttcagaatttcttcttctgggattttcacaagaacctggactgcaacccttcctctttgggctgttcctgtccatgtacctggtcactgtgctcgggaacctgctcatcatcctggccacaatctcagactcccacctccacacccccatgtacttcttcctctccaacctgtcctttgctgacatttgtgttacttccaccaccattccaaaaatgctgatgaacatccagacacagaacaaagtcatcacctacatagcctgcctcatgcagatgtattttttcatactctttgctggatttgaaaacttcctcctgtccgtgatggcctatgaccggtttgtggccatctgtcaccccctgcactacatggtcattatgaaccctcacctctgtggactgctggttctagcatcctggaccatgagtgctctgtattccttgctacaaatcttaatggtagtacggctgtccttctgcacagccttagaaatcccccactttttctgtgaacttaatcaggtcatccaacttgcttgttctgatagctttcttaatcacatggtgatatattttacagttgcgctgctgggtggaggtcccctgactgggatcctttactcttactctaagataatttcttccatacatgcaatctcatcagctcaggggaagtacaaggcattttccacctgtgcatctcacctctcagttgtctccttattttatggtgcaatcctaggggtgtaccttagttctgctgccacccgcaactcacactcaagtgcaacagcctcagtgatgtacactgtggtcacccccatgctgaacccctttatctatagtctgaggaataaagacataaagagggctctgggaatacatttgttgtggggaacaatgaaagggcaatttttcaagaagtgcccatgattgcagggctctaagcttcagaggtagtaactgtcattcttcaatcagatagtggaaatagaacttgctccttctattaatacttattatatttctgggagtttcaatttgttgtgatttcaactggtcttgtagaatttaagcaactccttttattaagctttctgctctctgatatccaacagttttttctctttgttgttttcctactttctcaaggttatttccgactttggatcagaaacactttggagatttccatttgtctcatacagggaagagttgtatgtctcctgtggcatagactacacttggcaattggggtaattgatgtaaatttatagtggaatatgacctgagaccacaatttgttcacttttgtattcttcagtcctatgtctgtctctaccttcaatgctcctcctgataatgtagacctgaacatacttgtgtattttgcagctggtcatgagattgtgttgtcctcattaggacatcatgtctttgtcagtgccatgtccacagtatctgccatactccctggcatagtacggtaaggcaaaaattgtttatcaaaaatatgttccgagtgcaatgcccactgaaagacaaacttgcatatgttgattaacttaatatggacttacagtcagagatgaccttaaatatgatggagtaaaattgtcaatcatacattgaattgctatggaagacttgtttttatgatgtgcatggactcattgaagtatggaagcttagtgcccatatataagtttatttattggagtgatggatttggtgccatggtctataatgtttcatgcatccatacttctgtttttgcttcaaaatttttagtgctccctacaaatacgaatccttctatcccactaaccaaaatacctccttcattataaaattttgtcgtaaacattaaagtgcaggtcagtgaaca

SEQ ID NO: 64348 - DNA, 569 bp, Homo sapiens
gtccatatctctcgtaatcacctaaatttcaaacctcagtggcaaagataataaattggtggccagtaaaccaaatctcacccataaatgttttgcttggcctacataatttaaaagttggagccaaaattatttttaaatacaagaaaaacatttctggtgtctcatgaaatattgaaagctgagccttcatttctacatggcaataatcagagctgaatatcaggctgagtatcataccatttgacaaatatgggttcttcatttctctaagtcagtgtatatctatctatttagatcagtttagttttgatcattttacttactgctgcccttgtaaggcatttaagtttttagtcctcactgtaaatgtttgttttttttcctgtttatcgagtatggccaagtagattgttaaatgagatacgttcttgctagctaagccatgacagtctaattttactaattcattttctgtttatatcaacaaaacacttctgtgtcttgatagggattttgattataagagtaagctttatcaaaatgtattaaactgtgctttatactta

SEQ ID NO: 64349 - DNA, 378 bp, Homo sapiens
ctgctccaccctcactcccgccaaaccactcaccccgtcactctctctaaattagccaattggaattagtttagcctgtgcggtctaacactagccaataggggaacgacacagcagcaggggccacgtgtgtcaggaataagaaccccttcccctcccttgtccaagtgtgtgctcaccattgctccatatgtaagggtgcacccttctatagaagtatattgccttgctaagaattaaaaagaaaattttatatttgagtgctatttcttttgcggcaccgaaactataacagtacccaatcacctagtctctaagggagaaatggacaaatgcataatcatggtaggagatttaacacacctcttaaaaaaaaaa

SEQ ID NO: 64350 - DNA, 386 bp, Homo sapiens
cagggcagctccttggtgcagctcctgctgcactgctggccccggtctggctctcttggtggctgtggccacccgtgccattgcatggtcctaacagtctctgtgtatattcagcttgcttcctgctgtggggccccactcctgctgcagaactcagcccctggttcaatgctgacctttgtaccccagtcccttaactacgcaggcatcttcctgtgtgtgtggtgttttgtaggtatacatctctctttcagcagctagctgaagtatgatttgcatacaacaagccgcatttatctaaagtgttatcagttgatatgttttgccttttgcaaatgacaccaaaagcatcaccacaatcgagataataaacagacccccccaaa

SEQ ID NO: 64351 - DNA, 527 bp, Homo sapiens
attgtcttaggccacacataaaatacactaacactaatgatagccgatgagcttaaaaaaaaaaaaatctgctgatgcacccatgagaggggagacagcactgtcgtctctcgcagttttcccttaacactcccttatctgcagacttaaactaggagcccctggcagagtcctacctccagaatcacaaaagtgtagaaggaaagtgagagacattgattgactttatatctgacttactagtttcctaaggcagagattttttagaaaactgcctggcctggcccagcccaggatagatagggatgggtaagaagcccttgagatgtggcagtatgtggcttgacttcagacttgtcagattaggggttttatagggtttttttagctcttgttttgattaagcttgtttgacttgcagggtgtctcctacctgtgttccagccacccgatttccttcctcaagaaaactgtttacttacactattcaaattagttattctcagggctatttttatgactttgta

SEQ ID NO: 64352 - DNA, 511 bp, Homo sapiens
tgaactttggtctcagaaaattgttaaactcctccagacacacagacggcccgagtcagtgacaagggatttcagtaacatcttagctacccctttgctatacagtggggaaactgaggcccagagaggagcagcacacaccttcaattgctgggcagctccagagcccttaaggagccattttctttgtcatttagggaccctcagctcctctgccatgcagaagtagctgcagttctggtacaaacctgcatttcctgccaagaaagccaactcaggtgggcggtaccaggaggctaaggctgagtcagggagcagtcaagcagtcatatttataacaaggccaccacaggaatcccactgctccaggccggaagggatcctgggggcaactcctcccacccccagcccgcctccctgtgcttgagtcctctaatgtgatttcaacctcccccgccatcccccaatagcctaaccctactctgtcaggttgagacttggactagtgggt

SEQ ID NO: 64353 - DNA, 4445 bp, Homo sapiens
  misc_feature (64)..(64): n is a, c, g, or t
  misc_feature (66)..(66): n is a, c, g, or t
cccgctgtccctttaaccccgccgccgggcgcacgtgagcggctccgggtggcacccggcgccncngccgccgaggcagttgtatttcgaacgtgcctctggctagcagccaggcgccttggctcgcggtccgcctggcctccctcctcctcatacttttcttcctgcgcaaccccctcccctttatccgcccacgattagaggtgggcactccccccaccaccaccccctccccaacgcaagcgcgtgcacgcacacacaccacacacactcacactcacacacactcacacacactcatcccacttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctgtctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaggggggggcaatctctctctgtgtctttctctctctctctccctctccctctctcttttcatgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaagccaaccttcaaagaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaatagatcaa

SEQ ID NO: 64354 - DNA, 1591 bp, Homo sapiens
  misc_feature (64)..(64): n is a, c, g, or t
  misc_feature (66)..(66): n is a, c, g, or t
  misc_feature (1569)..(1569): n is a, c, g, or t
cccgctgtccctttaaccccgccgccgggcgcacgtgagcggctccgggtggcacccggcgccncngccgccgaggcagttgtatttcgaacgtgcctctggctagcagccaggcgccttggctcgcggtccgcctggcctccctcctcctcatacttttcttcctgcgcaaccccctcccctttatccgcccacgattagaggtgggcactccccccaccaccaccccctccccaacgcaagcgcgtgcacgcacacacaccacacacactcacactcacacacactcacacacactcatcccacttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctgtctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggntgagggtaagagtatatgagga

SEQ ID NO: 64355 - DNA, 4593 bp, Homo sapiens
  misc_feature (64)..(64): n is a, c, g, or t
  misc_feature (66)..(66): n is a, c, g, or t
cccgctgtccctttaaccccgccgccgggcgcacgtgagcggctccgggtggcacccggcgccncngccgccgaggcagttgtatttcgaacgtgcctctggctagcagccaggcgccttggctcgcggtccgcctggcctccctcctcctcatacttttcttcctgcgcaaccccctcccctttatccgcccacgattagaggtgggcactccccccaccaccaccccctccccaacgcaagcgcgtgcacgcacacacaccacacacactcacactcacacacactcacacacactcatcccacttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctgtctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccgccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaggggggggcaatctctctctgtgtctttctctctctctctccctctccctctctcttttcatgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaagccaaccttcaaagaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaatagatcaa

SEQ ID NO: 64356 - DNA, 3118 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64357 - DNA, 1045 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccaggtagggtaacatcaggctttattgagcatggtccctttagtccctaatcttgcctttgcctggggacctattttacccaatttttaagagtaagtatagaaagtattgtgttgaagcaatattgaggaatcctgaaaatgttgatactcaaattctgatcctgattttgggaaagttttttcttcagcagttctaaatttcatgggttattcgtatctgctcagtgggtgcttcaaagtccagcaagtagctctttaaaatatttattcttgatctttagaacactatgaatagggaaaaaagaaaaaactgttcaaaataaaatgtaggagccgtgcttttggaatgcttgagtgaggagctcaacaagtcctctcccaagaaagcaatgataaaacttgac

SEQ ID NO: 64358 - DNA, 296 bp, Homo sapiens
ccacgcgtccgggctttgaaaactaacttctatcaaattgcatcaataacttaatagaagtagttttcaaagcctgtactactggagaaaaagggctcattctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64359 - DNA, 382 bp, Homo sapiens
cctaggcgtcggtgaagaatccaccacctcccgtagccaccatgtgttctaattgttcaactcccacttatgagtgtgagcatgcagtgtttggttttctgttgctgtgttagttctctgagaatgatggcttccagcttcatccatgtccctgcaaaggacatgaactcattcttttttatggctgctttttaacctttttaatgagtttggggaaagtgcattcctttctctcatgttgagacttaaaatttgtgctttgtgtctcctccagacttagcaatagggagaactagcagtgactaaggaggctgacattaatgccaattgtaagttaaaggctcatcttttccataggtctgattctgtgttctgactctgc

SEQ ID NO: 64360 - DNA, 2574 bp, Homo sapiens
agtgctgagattacaggcgtgagcccctgcgcccggccactgtttcagggaaaaaaaaaacacaaaacccaaatattgtattttttttataaatccaaactaaaataggtatttcatgtattctgacagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64361 - DNA, 3770 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaaaaaaaaaaaaaagaaaaaaaaaaaaaaaaaaaaaaaaaaaaaaaaacaaaaaaaaaacaacccaaaaaaaaaaaaaaaaacaaaagaaaagagcgagaaacgagacagagagcagacggagacgaaggagagaagggaggaaggagacagtgtgggcgggtggcgctggggcgagcgacgcgagcgaggaggagggacgataggtgggggcgtgagccgagcagagggagctagggagaggagaagagagggagcgagagaggcgacgtgagtgggggagcgcgagagaggggggagccgcagatcgcgggtgaggggaggagagagagagaaaagactagggacaccgaagccgcaaaggcgccgaatacaccgctgacaaagagggaatagcgaagaggatacaagggccgacgacaagaagaagagcgagaggcgagaccacgccgtatacacagagcagtgcaagaagcatgagaagaaagtcggagacgagagaggagagacgagactgaaagagagaacacgacagagtaaccacagagtaagggaaaggcgcagagatcaacgagtagctaagaacggagagacaggacgagacggacagcgagagaaaaaccgaaccagaagaccgggaaggcggagggcacgcgggcagcgaaacgggatgaaaccggcagagg

SEQ ID NO: 64362 - DNA, 3690 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccaaaaaaaaaaaaagaaaaaaaaaaaaaaaaaaaaaaaaaaaaaaaaacaaaaaaaaaacaacccaaaaaaaaaaaaaaaaacaaaagaaaagagcgagaaacgagacagagagcagacggagacgaaggagagaagggaggaaggagacagtgtgggcgggtggcgctggggcgagcgacgcgagcgaggaggagggacgataggtgggggcgtgagccgagcagagggagctagggagaggagaagagagggagcgagagaggcgacgtgagtgggggagcgcgagagaggggggagccgcagatcgcgggtgaggggaggagagagagagaaaagactagggacaccgaagccgcaaaggcgccgaatacaccgctgacaaagagggaatagcgaagaggatacaagggccgacgacaagaagaagagcgagaggcgagaccacgccgtatacacagagcagtgcaagaagcatgagaagaaagtcggagacgagagaggagagacgagactgaaagagagaacacgacagagtaaccacagagtaagggaaaggcgcagagatcaacgagtagctaagaacggagagacaggacgagacggacagcgagagaaaaaccgaaccagaagaccgggaaggcggagggcacgcgggcagcgaaacgggatgaaaccggcagagg

SEQ ID NO: 64363 - DNA, 1440 bp, Homo sapiens
cggcgaccctagaggacccagatatcgggatctgagtagtgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64364 - DNA, 1083 bp, Homo sapiens
atagtaacgtaatgagcatcgatataaatgtaagaatattaaagagatgaggcacacgagtcagatagcaccgattatggacggtacagagagtaaggacgtggtatgctcatgagcactacttcctgtacaaatatatatcagggtcgcatttgtcatgtgtaccgacctcgctgacgttattcgatagagaatgttaagtcttgatcactgcacatggcattcatacccacagagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64365 - DNA, 368 bp, Homo sapiens
gaatggtaacaggaacatttaagagcatttgatcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64366 - DNA, 1260 bp, Homo sapiens
  misc_feature (1201)..(1201): n is a, c, g, or t
  misc_feature (1218)..(1218): n is a, c, g, or t
  misc_feature (1225)..(1227): n is a, c, g, or t
  misc_feature (1231)..(1231): n is a, c, g, or t
  misc_feature (1240)..(1240): n is a, c, g, or t
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattctagaggtttgggtntacagctcattttagangagctcnnnattnttggtttgnttgccccaattccttttggg

SEQ ID NO: 64367 - DNA, 837 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggagacttagcaatagggagaactagcagtgactaaggaggctgacattaatgccaattgccaaggcgaacctagacaagaatgagcagaatgaggagaagag

SEQ ID NO: 64368 - DNA, 3087 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64369 - DNA, 2870 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 64370 - DNA, 3213 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaatcaacacaccacacactcacaaccaccacctacacgccatcagcgacacgaagccagcccgagcacaagcacaccgcgccacagacctacagagacacggccgcgctaaagcaccacgctccgcat

SEQ ID NO: 64371 - DNA, 848 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggagaatgaagttgagagcgtcacagggatgcttaacgaggccgaggggaaggccattaagctggccaaggacgtggcgtccctcagttcccagctccaggacacccaggagtt

SEQ ID NO: 64372 - DNA, 780 bp, Homo sapiens
gcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggagagctgcttcaagaagaaacccggcagaagctcaacgtgtcta

SEQ ID NO: 64373 - DNA, 500 bp, Homo sapiens
ctgattaacagaagatgcttctcttaccccattactcagatattgcaagttttatgagttctgtgctaccagggacaaagatcaaatacagtcaaatgctgactaataatgcttccatcaatgaccagctccatatagaacagtggtcacataagattataatggagctgaaaaattcctatcactagtgacaccgtagccaacataacatcattgcacatttactttattttataaataaatttagtataggctaagtgtggtgcttataaagtctacagtagtgtccagtaatgtcctaggccttcgcattcactcaccactccctgcctcatgcagggcaacttccaggcctggaggcttcattcatggtaagggccctatacagatgtactatttttaaaaaaatcttttatagtgtatttttactgtactttttgtatgtttagatatgtttatatctaacactaataatatcataatactatcataaatcctta

SEQ ID NO: 64374 - DNA, 305 bp, Homo sapiens
actacttcctttagccaggggtatccataacttccatgaacatcagtcatgctaattttgatttaagaaatgtcttattagtctcagaattaatgcatctagtaacaatgtaaaaatgttcaagatgacatagtcagaacttgctatcaataaaaagtgggtcttatgtggctgttccttgtgacattatctgattgagaacatttgactgaggacctgactcaatataaaagtcctaaacccttttggctgcctttccctttggctgaaatgggaaaataaagctatttcaacactaattggaa

SEQ ID NO: 64375 - DNA, 468 bp, Homo sapiens
gttgttggttatttcctttgagatttgggtataggctaaggaggcttttgtgatttcagcaattctggttcccatactggctataatgccaagtcccacaaaaaggggagttaaataaatagcttttaaattaatatttgtcctctagaattctagaattctcctgaaaattaaagatgataagctgggagtggtggctcgcgcctgtaatcccagcactttgggaggccgaggtgggtggatcatgaggtcaggagatcgagaccattctggctaacatggtgaaaccccatctctactaaaaatacaaaaaattagctgggcatggtgtcgggcgcctgtagtcccagctactcgggaggctgaggcaggagaatctcttgaacccgggaggcggaggttgcagtgagccgagatcacgccactgcactccagcctgggggttagaagatgtgagactctcatctc

SEQ ID NO: 64376 - DNA, 2551 bp, Homo sapiens
ttctcagtctcttttggtgaattctttttctctactatcttttaaataaataaatgttgatgtgcccaggcttctacactgtatcttctccccagatgatctcatcccacatttatttatttataaatagagatagggtcttgctgtattgcccaggtcttgagctcctgggctcaagcggacctcccacctcagcctcccaaaatgccagaattaacagatgtgagctaccgatcctagcccatccccacactcttgaatttcacaccacccaaatttgagccactaactcagagttctccccatggcttcactatatctagcttcctcctgtgctccatctgaacacatattattcattccctcatataagatatgctgctcttcttgttttccctatcatattagttggtgctactagccaccaagactctcaagccaaaagactgaaaattatcctagtttacactttccctcaccccactcttaatcagtcactttattcttcctctgtgtatctgaatctcatccacttctctccatcctcacagccatcgcccgtttgcccacctggtttcactagactggactctaccctcaaatctcaccatcctccaccctattctcccattccccctgtcagacacttcctcacgttgcataaaaggttagttatcataaatgattcactacaatctgttcccaagctttaccctccagcactgctaagacacttcattttggcatgcaccattttgtaagatactcaaaatccttttcgggacaataaaatatacatacccttgatacctgaagtgtgtttctgaggccctgaagcgtttgcattactgtattaaaaattcacagttgcagtcaggcccggtggctcatgcctgtaactccagcactttgggaggccaagccaggcagatcactggagatcaggagttcgagaccagcttggccaagatagtgaaacctgatgtctgctaaaaatacaaaaaattagcccggtgcggtggtgggttcctgtaattccagctactcaggaggctgaggcaggagaatcgcttgaacccaggaggcagaggttgcagtgagctgagatcatgccactgaactctagcctgggtgacagagcaagactccatcttaaaaaaaaaaaaaaaccagccaggtgtggtggcttatgcctgtaatcgtagcactttgggaggccgaggcaggctgatcacctgaggtcgggagttcaagaccagcctgaccaacatggagaaactctgtttctactaaaattacaaaattagctgggtgtggtggtacatgcctgtaatcccaactactcaggaggctgaggcaggagaatcgcttaaacccgggaatcggaggttgcggtgagccaagatcatgccatttgggcggcaagagcgaaactccatctcaaaaaaaaaaaaaaaaaatccacaactggctgggcacggtggctcatgcctgtaattcttgtttcggaggatgcctgtttgggaggatcgcttgggcccacaagtttgagaccagcctgggcaacatagtgagaccccgcctttacaaaaaatttaaaaattagccaggtacagtggcatgcacctgtggtcccagctattgaggacactgaagtgggagggtcacctgagcccaggaggttgaggctgcagtgagccatgattgtaccactacactccagcttgggtgacagtgagaccctgtgtcaaaaaaaaaaaaaatccaaaatctcacccagaccaatactgtatcagaattatcattttaacaatatctccagatgatttatatgcacattaaagtttgagaagctggccaggtgtggtggctcacaccagcactttgggaggccgaggcagataggttacttgagctcaggaattcgagaccagcctgggcaacatggtgaaaccttgtctctataaaaaatccaaaaattagcccggtgtggtggtgggcacctgtggtcccagctactcaggaggctgaggtgggaggatggcctgaacccaggaggcagagtttgcattgagctgagattacaccactgcattccagcctaggcagcagagcaaaaccctatctcagaaaataaatagtttgagaagcaatctttttttaaatgagtgaagaaatcagacctaaggagaaatctgatgaagccagagctgagttaatattgataaatggatgcagtcaggtggtctatacttaatttttggtgaggggaagggacagtggaggcagtattgattttgaggaagccaaacaggacagcctgatgaattcaagatttccagcatatatacatcttcaccaatcccaccaccttgctccagcctgtcatatcactgtgtctacataaaaaaaaaaaacaaaaaaaaaactccaaggccaaactctctgacctttctttccttctaaagaccaagccctcctcactagccccctgcccctccttagttaactggcaaagagatcaaagggcaggccttctgactggtgatgc

SEQ ID NO: 64377 - DNA, 391 bp, Homo sapiens
gcctccacagtgccagcctgaaccccccacctctttagacaagttttacatcctggtgaacatcttcccagggatctgatcagaagcaattctttggttttccagttttcccaggaggaaggtggcctaccaggttgggacagatagatggcattcaaacaccaaggatgacgagctcgctgccctccaggtcctgtcgcattctggggacctgagtggctggggatgtggagcacacctgcagaacaggagagaacattccaaacccttctctaactggcactgaagaaagtgcgagccattaccagcattctctcttccgatactctccaaagtttttagtatctacaagacttttaatttcatataaaatatttcagaaaaatcgaat

SEQ ID NO: 64378 - DNA, 2219 bp, Homo sapiens
  misc_feature (60)..(60): n is a, c, g, or t
  misc_feature (621)..(621): n is a, c, g, or t
  misc_feature (1207)..(1207): n is a, c, g, or t
atatctgggatcctccaatcacatctgagacctcctaggctctccatctgatatgccctntcagggaccccacaaagactgagttctcatggggatcctacccttcctagtgccactccctatggccatgctgaagaccactctggccacgcgactgattttgggtgatcatggcagctccccacccatgtcatttctaaccagaagtctcaaggtcgtcacccccctgccccccaaccgaggccccggtcgctggtggtggtctctttagtgcactgtagcacttggtggtggaggtgtgagggatccacattaacagcaggccatcagctgggcaacggctcacacctgtaatcccagcactttgggaggcgaggcagggggaatggcttgaacccaggcattcaagaccagcctgggcaacataatgagacctcgtctctacaaaacataacaaaaacaattagccgagcgtgggggtgaacacctgtggtcccagctgctcaggaggctgaggtgggaggatctcttgagcccaggaagtaggaggctgtagtgagctgtaatcgtgccactgcactccagcctgggcgacagagtgagacaccgtcttaaaaacanaaacaaggccgggcacggtggctcatgcctgttgtcccagcactttgggaggccgaggcaggcggatcacgaggtcgagagatcgagaccatcctggccaacatggtgaaaccctgtctctactaaaaatacagaaattagctgggcgtggtggcacgtgcctgtagtcccagctactcgggaggctgaggcaagagaatcgcttgaacgtgggaggcagaggttgcagtgagcctagattgtgccactgcactccagcctgggggacagagcgagactccgtctgaaaataaaaacaacaaaaacagcagaccattcaaaatagggagactttgcataatccagatttctgccttcacttaaaactttggacggtctggagagagtcggccagttttcggtggggggtggggagctggaacaggacagtagcctttcctaatgaggcatttgttctccaatctgccccagtcgctgccatccctggctatctcaccctagcagcttctcaagcctgttggctttagaccactgtataaacccagctggaactgaagcctgggtggactatggagccctggttggnacccccagggagtcaaaggctgcgggccaagaggccagaggtccttgagcctgggtgggcaggtggatctagggtgcatgacttgctgcttcccaaccttagtttgtcccttctgtgaaaaagggagagaaggaggaggaagatctcaaaaagactttccagcccagtgcggtggctcacgcctgtaatcccagcactttgggaggccgatgcaggtggatcacctgaggtaggagttcaagaccagcctgaccaacatagtgaagccccttctctactaaaaatacaaaattagctgggcgtggtggcatgtgcctgtactcccagctacttgggaggctgaggcaggagaatcgcttgaacctgggaggcggaggttgtagtgagctgagatcacaccactgcacaccagcctgggcgacaagagcgaaactccgtctcaaaaaaaaaaaactgttgcagccccgttgagcctttgacaccgcctgaaatccaccccactcccaggaggaggaggaggaaggaatgccaatgacctagagacacgagaagtccatgtggaggcacacagcagctgatggcagagcccaggctgggacctgcccttaagagaatgagtgggaagggggagggaggaagggcaggtaaaacgtcctccccagggccccctgcaacggggaaggtactttttacaaaagctatcattgtcaccctaaatgtggaataaaataagatgcatcgacgtagacaaacctcctgggaccttttgtcagggactgcaatcctgcccctccactgaggccgctggctctcagagacaccgtgacatcacgggtgatgatgagaggagttcaaagagagaattatatgctggcgcggtggctctgtaatcccaacactttggggggccaaggcaggaggatcgcttgagtacaggagtttgaaaccagcctgggcaagatagtgagatccccttcccacccgtctacaaaaaaaataaaaaattagcggg

SEQ ID NO: 64379 - DNA, 1953 bp, Homo sapiens
  misc_feature (60)..(60): n is a, c, g, or t
  misc_feature (621)..(621): n is a, c, g, or t
  misc_feature (1207)..(1207): n is a, c, g, or t
atatctgggatcctccaatcacatctgagacctcctaggctctccatctgatatgccctntcagggaccccacaaagactgagttctcatggggatcctacccttcctagtgccactccctatggccatgctgaagaccactctggccacgcgactgattttgggtgatcatggcagctccccacccatgtcatttctaaccagaagtctcaaggtcgtcacccccctgccccccaaccgaggccccggtcgctggtggtggtctctttagtgcactgtagcacttggtggtggaggtgtgagggatccacattaacagcaggccatcagctgggcaacggctcacacctgtaatcccagcactttgggaggcgaggcagggggaatggcttgaacccaggcattcaagaccagcctgggcaacataatgagacctcgtctctacaaaacataacaaaaacaattagccgagcgtgggggtgaacacctgtggtcccagctgctcaggaggctgaggtgggaggatctcttgagcccaggaagtaggaggctgtagtgagctgtaatcgtgccactgcactccagcctgggcgacagagtgagacaccgtcttaaaaacanaaacaaggccgggcacggtggctcatgcctgttgtcccagcactttgggaggccgaggcaggcggatcacgaggtcgagagatcgagaccatcctggccaacatggtgaaaccctgtctctactaaaaatacagaaattagctgggcgtggtggcacgtgcctgtagtcccagctactcgggaggctgaggcaagagaatcgcttgaacgtgggaggcagaggttgcagtgagcctagattgtgccactgcactccagcctgggggacagagcgagactccgtctgaaaataaaaacaacaaaaacagcagaccattcaaaatagggagactttgcataatccagatttctgccttcacttaaaactttggacggtctggagagagtcggccagttttcggtggggggtggggagctggaacaggacagtagcctttcctaatgaggcatttgttctccaatctgccccagtcgctgccatccctggctatctcaccctagcagcttctcaagcctgttggctttagaccactgtataaacccagctggaactgaagcctgggtggactatggagccctggttggnacccccagggagtcaaaggctgcgggccaagaggccagaggtccttgagcctgggtgggcaggtggatctagggtgcatgacttgctgcttcccaaccttagtttgtcccttctgtgaaaaagggagagaaggaggaggaagatctcaaaaagactttccagcccagtgcggtggctcacgcctgtaatcccagcactttgggaggccgatgcaggtggatcacctgaggtaggagttcaagaccagcctgaccaacatagtgaagccccttctctactaaaaatacaaaattagctgggcgtggtggcatgtgcctgtactcccagctacttgggaggctgaggcaggagaatcgcttgaacctgggaggcggaggttgtagtgagctgagatcacaccactgcacaccagcctgggcgacaagagcgaaactccgtctcaaaaaaaaaaaactgttgcagccccgttgagcctttgacaccgcctgaaatccaccccactcccaggaggaggaggaggaaggaatgccaatgacctagagacacgagaagtccatgtggaggcacacagcagctgatggcagagcccaggctgggacctgcccttaagagaatgagtgggaagggggagggaggaagggcaggtaaaacgtcctccccagggccccctgcaacggggaaggtactttttacaaaagctatcattgtcaccctaaatgtggaataaaataagatgcatcgacgta

SEQ ID NO: 64380 - DNA, 272 bp, Homo sapiens
tctgatacctattaaaattacatttcaagatcatcaaattcataattttcagctattcagatttaacatccctgaaattaaacttaagcataaagataacagggataatccagttcccatacccaggagaataacggtcacctcaagtccactataatacaccaagtctgaaccctggactcaacatgttttcaataaaatgttcactttaaagttttgacaatgacttaataaccagggcactatgtttgatccatgcaaaaagatgtaaa

SEQ ID NO: 64381 - DNA, 327 bp, Homo sapiens
ggatggggtagcctcatgcattccaggcgggagcattgactggcacagccattctcaggagtactccagcattctctggtccaatcagtcatgcacacatcatataaatcctactctcagacataaagcccagaaacattctctcacacaggtccatacggccatgggggagggggatccatgcaatgctgtttgcactgaactggactccacccaggtgtcactcactgggggcctggataataaaatgtggtgttggctcactaacaaatatgatcgaatatgatcaactagaccaggggttcccaaacattctcacttcatgca

SEQ ID NO: 64382 - DNA, 2886 bp, Homo sapiens
ggaatggatgacctaaaagtggactgggatgggggtggcagggctgagtctgtgagggtgggcgggagggaacctagtcccagagtcttctgcagcctggaccagactacttaagcactgctgggtttagactgtcctttaaaataagagccgctagaagtgaacttctcattctgtccgtccctaattctgtccttctctaaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgtagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaa

SEQ ID NO: 64383 - DNA, 2844 bp, Homo sapiens
cagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgtagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttttccttatg

SEQ ID NO: 64384 - DNA, 2880 bp, Homo sapiens
  misc_feature (2823)..(2823): n is a, c, g, or t
  misc_feature (2827)..(2827): n is a, c, g, or t
cagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgtagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaaaaangatncgcccagatttccctttcttcatccaatcccgtacagtaatctatcaattttc

SEQ ID NO: 64385 - DNA, 1040 bp, Homo sapiens
cagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaaggtatagaaataaacatgttgtcacagaa

SEQ ID NO: 64386 - DNA, 2726 bp, Homo sapiens
cagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgtagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaa

SEQ ID NO: 64387 - DNA, 1919 bp, Homo sapiens
agctacatgtaattttacataacccagggaaaactagcatgctttgttctcaggctccctgccatggtcaaaagcaccccaaatctgaaaagattcttggtaatttattccctttcatccctaaagaggagcctttaagatatgtcagggttgatctttttttcagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgtagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttttccttatg

SEQ ID NO: 64388 - DNA, 820 bp, Homo sapiens
cagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagtgaaatgagcgcctctaccactggaaatttctccaggagtattccataaagcaaacacatttcatgataaccttttagctactgttatatcagcaaccttcctgcatgacgggaaagcttctgtacatccagaaactattcattgaaggacctctccaaggagaactgcaaaccactgctcaatgaaataaaagaggacacaaacaaatggaagaacattccatgctcatgggtaggaagaatcaatatcgtgaaaatggccatactgc

SEQ ID NO: 64389 - DNA, 521 bp, Homo sapiens
  misc_feature (37)..(37): n is a, c, g, or t
  misc_feature (53)..(53): n is a, c, g, or t
  misc_feature (104)..(104): n is a, c, g, or t
tgagacagaatctcgtgctgttgcccaggctggagtncaatggtgtgatctcngctcactgcaacctctgcctccggagttctcctgcctcagactccctagtngctgggactgcaggcacccgccaccatgcccagctcccctcccttaaaggcataagtagtgcaagctgactccgagcacatccaggaatgcgcttactgatgagatatcgaggcaagctaaatcagcagttcctgaggacgcgcttgggggatggcacccaaagcccctgcattatctctttgtgatagtttgagcccctgcacctggaactgtttacttttctgtaactgtttctgtaaccaattaatctttcttaattggtttgcctgttctgcttctgtaaaaattgcttcagctaaactccctctcccctatttagaccacgatataaaaagaaatctagccccttcttcggggccgagagaattttgagctctagccgtcttgttcgccggcaataaaaggactcctgaatt

SEQ ID NO: 64390 - DNA, 858 bp, Homo sapiens
aaatgtcctgtaaacacacatgtctgattcctatgtcacttctgatgcagattgtgaaatcaagtctttactattaacagctttttattgcttgctgtcttctttgtgttttagctcttcttctctgctgaaatgtgagctttttgaagtaggagggagattttgagtttcttttttatcttataaaatatcgagttcagtgatggacatatataaactagacattaattataagttgattattaaaataatcacatccttctttgtgggctaagccgttgacacggtagtctaatttcagctatcatgccactgagttcttatgtgatgccattaaaaatgcccacattaaaaaaatgactataatctgaattgtataaagaaggtaatgtgataccctacctcgttttaacctgattgtctctcttagctgagagagccggacagactccatttttgtttcttcacttgcagctcccctcccttaaaggcataagtagtgcaagctgactccgagcacatccaggaatgcgcttactgatgagatatcgaggcaagctaaatcagcagttcctgaggacgcgcttgggggatggcacccaaagcccctgcattatctctttgtgatagtttgagcccctgcacctggaactgtttacttttctgtaactgtttctgtaaccaattaatctttcttaattggtttgcctgttctgcttctgtaaaaattgcttcagctaaactccctctcccctatttagaccacgatataaaaagaaatctagccccttcttcggggccgagagaattttgagctctagccgtcttgttcgccggcaataaaaggactcctgaatt

SEQ ID NO: 64391 - DNA, 830 bp, Homo sapiens
agacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcgtattatgagagcggctacaacaccacagcccagacggtcctggatgacggcagcatcgactacggcatcttccagatcaacagcttcgcgtggtgcagacgcggaaagctgaaggagaacaaccactgccacgtcgcctgctcagccttggtcactgatgacctcacagatgcgattatctgtgccaagaaaattgttaaagagacacaaggaatgaactattggcaaggctggaagaaacactgtgaggggagagacctgtccgactggaaaaaagactgtgaggtttcctaaactggaactggacccaggatgctttgcagcaacgccctagggtttgcagtgaatgtccaaatgcctgtgtcatcttgtcccgtttcctcccaatattccttctcaaacttggagagggaaaattaagctatacttttaagaaaataaatatttccatttaaatgtcttcacaaaaaaaaatcccggcggatcggcaaagggcgaactcaagggggccggacctttgtc

SEQ ID NO: 64392 - DNA, 811 bp, Homo sapiens
agacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcgtattatgagagcggctacaacaccacagcccagacggtcctggatgacggcagcatcgactacggcatcttccagatcaacagcttcgcgtggtgcagacgcggaaagctgaaggagaacaaccactgccacgtcgcctgctcagccttggtcactgatgacctcacagatgcgattatctgtgccaagaaaattgttaaagagagcaaggctggaagaaacactgtgaggggagagacctgtccgactggaaaaaagactgtgaggtttcctaaactggaactggacccaggatgctttgcagcaacgccctagggtttgcagtgaatgtccaaatgcctgtgtcatcttgtcccgtttcctcccaatattccttctcaaacttggagagggaaaattaagctatacttttaagaaaataaatatttccatttaaatgtcttcacaaaaaaaaatcccggcggatcggcaaagggcgaactcaagggggccggacctttgtc

SEQ ID NO: 64393 - DNA, 913 bp, Homo sapiens
agacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcgtattatgagagcggctacaacaccacagcccagacggtcctggatgacggcagcatcgactacggcatcttccagatcaacagcttcgcgtggtgcagacgcggaaagctgaaggagaacaaccactgccacgtcgcctgctcagccttggtcactgatgacctcacagatgcgattatctgtgccaagaaaattgttaaagagacacaaggaatgaactattggcaaggctggaagaaacactgtgaggggagagacctgtccgactggaaaaaagactgtgaggtttcctaaactggaactggacccaggatgctttgcagcaacgccctaggtgtggcccagggaagtcaaaagattggatacccctgattggaaaactgactccaaaaataagtgcttcaaaattcaagattcagcaagcacctctgtttaaactgatcctccagtaacagaaagagaagaggaagcacaagggcagaagctaataagcagagtcttgctggagaacaggagagaggagagaggtgatttctaacaggacctgcagacacttcgacaagataaactacattttatgtgaaataaaggcatgttcaaaaagc

SEQ ID NO: 64394 - DNA, 758 bp, Homo sapiens
agacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaactggcaaaaatattctcgagggctggcctggacaattactggggcttcagccttggaaactggatctgcatggcgtattatgagagcggctacaacaccacagcccagacggtcctggatgacggcagcatcgactacggcatcttccagatcaacagcttcgcgtggtgcagacgcggaaagctgaaggagaacaaccactgccacgtcgcctgctcagccttggtcactgatgacctcacagatgcgattatctgtgccaagaaaattgttaaagagaactgtgaggtttcctaaactggaactggacccaggatgctttgcagcaacgccctagggtttgcagtgaatgtccaaatgcctgtgtcatcttgtcccgtttcctcccaatattccttctcaaacttggagagggaaaattaagctatacttttaagaaaataaatatttccatttaaatgtcttcacaaaaaaaaatcccggcggatcggcaaagggcgaactcaagggggccggacctttgtc

SEQ ID NO: 64395 - DNA, 459 bp, Homo sapiens
agacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgccgagtccaaaatctacactcgttgcaaatggaactggacccaggatgctttgcagcaacgccctagggtttgcagtgaatgtccaaatgcctgtgtcatcttgtcccgtttcctcccaatattccttctcaaacttggagagggaaaattaagctatacttttaagaaaataaatatttccatttaaatgtcttcacaaaaaaaaatcccggcggatcggcaaagggcgaactcaagggggccggacctttgtc

SEQ ID NO: 64396 - DNA, 4338 bp, Homo sapiens
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgcgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagctggaatgcaatggtgtgatctcagctcactgcagcctccgcctcctgggttcaagcgattctcccacctcagcctcccgaatagctggaattacaggcacctgccatcatgcccaactaatttttgtatttttgtagagacagggtttcaccatgttggccaggcttgtcttgaactcctgacctcaggtggtctgcttgcctcagcatcccaaagtgctgggattacaggtgtgagccaccatgcccggtaaacttttaaaaatgtaagcaaaattacagtatgtaaaacacacattgctaatggagaaataaagttcctacttttacatctaaaaaaaaaa

SEQ ID NO: 64397 - DNA, 5002 bp, Homo sapiens
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgcgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtaagtgccttctgaaactgctgcagtttctctttgggggtattggtagccattcagtatttttttcaaaagaattctgttgacattaaatgatatcagcagtccagaagtcttggcaaaatgtaataagatgtaaataatcttatatattcataagtgttataaaatctcataagattaaaatattgccttcccttacagatagtcacttgtgtttattacaatttagagaggaataaagatgtacatgaatatacactggtaaatttacaact

SEQ ID NO: 64398 - DNA, 2099 bp, Homo sapiens
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaagtaagtatttttaaatgaaatacttttgagtaaagaatattaatgatacctttttttctactgatacctttgtttctgttcattcttgagaagagaagtgagaaggcatgtgcctgattcagagagtttaaatcactggagttgagttgatttgggtactatttttcttgctcaaagacagtcagtattattatttgataactgtagaaatgattggtatgtcacagagcactaacaaatagtgattacctactttagtagtttttctccctttatggtgtctatgttttcatattaatgaattacttcaccttttaatattttaggatttgcacataccgtaagcttgactattttttgaaacttttttgtgtacttggtgatgttgcaaaaatcaaaagttttcaaagccaattttaaacaaaacctgaataagttaaaaatgtgtagtttaaaaaataaatactgttttttgaactct

SEQ ID NO: 64399 - DNA, 2607 bp, Homo sapiens
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaagtaagtatttttaaatgaaatacttttgagtaaagaatattaatgatacctttttttctactgatacctttgtttctgttcattcttgagaagagaagtgagaaggcatgtgcctgattcagagagtttaaatcactggagttgagttgatttgggtactatttttcttgctcaaagacagtcagtattattatttgataactgtagaaatgattggtatgtcacagagcactaacaaatagtgattacctactttagtagtttttctccctttatggtgtctatgttttcatattaatgaattacttcaccttttaatattttaggatttgcacataccgtaagcttgactattttttgaaacttttttgtgtacttggtgatgttgcaaaaatcaaaagttttcaaagccaattttaaacaaaacctgaataagttaaaaatgtgtagtttaaaaaataaatactgttttttgaactctttcagatgaatgactacagttaatattttgggaaaaaaacatgtttaaaaagaatatgaaactttaaattatgtgattttcctttgtgataaaaatgttagaatattaaagaccttttatgtcaattttttacctatttgagtctataattgaatattgccatactgagtatacctagttatataattacactcccttttaatgtatagataagaatgaaacatgggctgggagcagtggctcacacctgtaatcccaacactttgggaggccgaggtgggttgatcacctaaggtcagtagtttgagaccagcctggccaacatggtgaaaaccccatctctactaaaaatacaaaaattagtcaggtgcagtggtgcacacttgattgaaatcccagctactcaggaggctgaggcaggagaattgcctgaacccgggaggcggacattgcagtgaggcgagtttgtgccactacatgccagggtgacaaagcaagacactgtctt

SEQ ID NO: 64400 - DNA, 344 bp, Homo sapiens
gtctgacattttatattatccctactttttgttactttattacattagactgtattgtaactgatcttttcccatgatccattgcagttcaatttcatattgcccatttgtatgaaacccaggtaagtgttttaacttaagaacaagaatgaaacagtcacctatgctttagatgaaatgaaatgtacttgaaaatatcaggctttaaatgaaataaatatattagacgatttgagttgtgggtattatactcttgcatgtattttgtattctactcctcattaaatgtgtttgaaatttttagtgaacaaattgttaaagacaaatgaaggcatttgagattt

SEQ ID NO: 64401 - DNA, 6540 bp, Homo sapiens
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgcgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctctttctgaagca

SEQ ID NO: 64402 - DNA, 1167 bp, Homo sapiens
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggagcaaagaaaatggcggaaggaaaagcgagccgcgagagtgaagaggagtctgttagcctgacagtcgaggaaagggaggcgcttggtggcatggacaggtacgcacctccatcacccgcctggttggctggcgatactctccgggaaggcctggacgcagacgcgcctatggttgatga

SEQ ID NO: 64403 - DNA, 592 bp, Homo sapiens
ttaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacaggtacgcacctccatcacccgcctggttggctggcgatactctccgggaaggcctggacgcagacgcgcctatggttgatgacggggtcatcctcagcttggcactcaccaatctgtcgctgtcgctcttggactcgggaaggagcaagtcactggctttctcagaccattaacaagctctgtgtctctctctctacagccgtctcttcgggttcgtgaggcttcatgaagatggcgccagaacgaagaccctactaggcaaggtaaaagcaaccagacgcaaagtctttggtccgcactttgctctaccaaggccccgcgttccttaccgcccagccagtatttattttggctctgctccatggccaaggggtcggaaaagtgtttcttgcctttg

SEQ ID NO: 64404 - DNA, 1386 bp, Homo sapiens
ggcacgagggaagagaggctcagagggctgaagtgcctatttggccgaaagccgtggcagagtggcaaggcagggccaggggaagcggctccgccgccggggccgggcccctgtttggcccggtgcccggtccttagcctgaaggtggcgggcttccgccagaagcccctggcggaagcggtgcccgcgtgcgggccagagtgtgggtgtgcaggtctctgggcggcccaaagggggtgcccctgcctggtaacctagcgggagggtggggacggcggggagggcggcgggcgcggggcacggctccgctgctcagggcaggctccgcccccaggggcgcggatttaaaaggatcgaaggcagccccggagcccagcggccgggaagcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataatggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctttacaaaaaagaacaaacaaaaaaaaaaaaaaagcaaaaaaaaagaaaaagaacacaaaccacaaccaaaaacaaaaaaggcgggggcgggacaaaaaacacccggggggccaataaacaggcaccccaggtatgaaaaggcgcgccaaaggagcgcaatcaaaacgagcggcagccgccgcgttacaaaccaccgggcgaggcgacaaacgtgacacacgagcacagaggagaacaccaccacggcggggcgaccacaccggggccccccacaccggatatcaacagccgggaaacacacacgcgacgagatggagaacccgcctataccgcgggaagtccgggtaaatcaacgaccgacgcc

SEQ ID NO: 64405 - DNA, 1027 bp, Homo sapiens
ggcacgagggaagagaggctcagagggctgaagtgcctatttggccgaaagccgtggcagagtggcaaggcagggccaggggaagcggctccgccgccggggccgggcccctgtttggcccggtgcccggtccttagcctgaaggtggcgggcttccgccagaagcccctggcggaagcggtgcccgcgtgcgggccagagtgtgggtgtgcaggtctctgggcggcccaaagggggtgcccctgcctggtaacctagcgggagggtggggacggcggggagggcggcgggcgcggggcacggctccgctgctcagggcaggctccgcccccaggggcgcggatttaaaaggatcgaaggcagccccggagcccagcggccgggaagcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataatggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctttaca

SEQ ID NO: 64406 - DNA, 596 bp, Homo sapiens
cctcttttctcttcctttttcctttatttatttatttctcttttcttctctttctttcaacaaggtctcactctgtctcccaggctggagtacagtggtgcattcatagctcactgcaaccttggactcctgggctcaagtgattccccaatctcagccacctgagtagctgggactataggtgttagccaccacacctggctatttttattttatttctgtagagacaaggtcttactatgttgccaaggctggtcttgaattcccaatgttctcttttagtagtttcatagtttcaggtgtcagatttaagtctttaagccactttgatttgatttttttatatggtgagagataggggtctagttcattattctgcatatagacatctagttttcccagcaccatttattgaaaagactgttctttccccaatgtatgttcttggcagctttgtcaaaaatgagttcattgcagatgtgtggattcatttctgaattctctactgttacattggtctatgtgtctgtttttataccagtaccatgctgtttcgggtctctagttctacaataaacttcaaagtcaggcaatgt

SEQ ID NO: 64407 - DNA, 546 bp, Homo sapiens
ccgatatttaaagatagataaacaggaaactgagggagagaggattgggaacctgggggcagaggaattgaatcctggcagaggagaatttggaggaaaaatatgttttaggaaccttattctttgccctccccaaacagaaaaaggttttttttttctttgaaattttatttcaaagacctttggatatttttaagtatccatcaaaatgttatgagatcatgaatttcatggacctcaacacaccaaatatattgagcactattaaaagtgcacagtggaaaataaaagatacccacaatttcctttttgccaaatatattttggtttcccccgattaaaaaaaaaattcaacttgagcctcatgattatctgaatactcagcctttctatatatttctatgttatctttctaccctattctattattctgtaatatatcagctgcagttcagtcaaccaaatcacccattgttttccttctggctgttgtcctcagagtttcccatccttccttgtttaggaggcccaaggctatgcctctcg

SEQ ID NO: 64408 - DNA, 525 bp, Homo sapiens
tgccaagctttccctctaggatttcctttgtggcctccattagctaacaattctccgttttagccgcttcttggctcttgcaggttgcagttttctagattttgctttgtcattctttctcttgcccctttcattgtccagaaatctgttgaaaaaattatatccactgataattacatcccatactcttcattttttaaactttttatctttattatttattattgtagtatggtgtctctgaaagattggagaagaatgtttataatcttaaaccagaagccttgggtatcacagcataataattaaggttttatattgtttatgattatttgagccaaaggctttctaccatttatcaaaacaaagtatttttgtaaacttcaatatacattaatttttttcagaaatgcaacacaaatatgaaaacaaataaatattatacttcattttttcctgaactttaccaagggttgttcaccatttcaaaataacatttacctcttgagttaccagataacaacc

SEQ ID NO: 64409 - DNA, 346 bp, Homo sapiens
ggaaagatgcacaagaaactaataaagtacttttactaatttggcagggttggaggggtgaggaaaattgggaactgagcagatggggaattaaggggaggacactactcgctgtgtatctccttctatatcttttgaattttgaaccttgtaaatgtattgcctattcacacatttaaaaaaacgaaacaaagtgttctacccagtgggcatccctctctcagccatgcaccgtgacggcagagtacaagttacaagtcatgcctgagtctgggaggtccacggttgggaatccatcactggcttttgtgagcaaggcaggtcacgcggatacaaagcatctttc

SEQ ID NO: 64410 - DNA, 657 bp, Homo sapiens
gctgccatttctttccttatactctcccttcttttcagatgtcttttttattcattgatagaattcattatttatttaatgtttttgagaatgtagtcagccaagtttcttctacctctttggtttgtttgtttgtttgtttgttcgtttgtttgtttgttttttagtcggagccttgctctgtcgcccaggctggagtgcagtggtgcaatcttggctcactgcaacctccgcttcccaggttcgagccattctcctgcctcagcctcccgagtagctgggattacaggcatgtgtcaccatgcctggcttatttttgtatttttagtagagacggggtttcaccatgttgaccaggctggtctcgaactcctgacctcaggtgatccgcccacctcggcctcccaaagtgctggaattacaagcatgagccactgcacccagtctgttgtttctttttatgatacagtatcttgtcattggttccattttatttactaaataaatggaaaattctgtttactgaagtgtctttcctttataactgataccctgcagaacccctaagttttattttgctttcataaggttgctcttttttaaatttttaatgaaagagtaaggactcaagtaggtcaagtggcgacagttttatgt

SEQ ID NO: 64411 - DNA, 350 bp, Homo sapiens
gctgccatttctttccttatactctcccttcttttcagatgtcttttttattcattgatagaattcattatttatttaatgtttttgagaatgtagtcagccaagtttcttctacctctttggtttgtttgtttgtttgtttgttcgtttgtttgtttgttttttagtcggagccttgctctgtcgcccaggctggagtgcagtggtgcaatcttggctcactgcaacctccgcttcccaggctgaggcagaagaattgcttgaacccgggaggcagaggttgcgatgagccaagattacaccacgcaccccagcttgggcaataagagttaaactctgtctcaaaaaag

SEQ ID NO: 64412 - DNA, 421 bp, Homo sapiens
atacagttttctagtacaagggatcttgatgaagttcatggaaaaatacatattatgagaaaattgtgcatgaatttcacagtttttgcaccaaattaaactggtacaagtctgttataacatgtctgaacaggctgtagttgaaggcactcagaaggataagacataagtttgaaaagagactctatcaaagtaaaataaattctgctaaaattgaaacaaaaagaaacatcaaatttatgatgagatcagatgcagtgtcaccacaccctgctaatttttgtatttttagtagagatgggtttcaccatgttggccaggctggtcttgaactcgtgacctcgtgatccacccgcctcggcctcccgaagtgctgggattacaggcatgagccactgcacctggcccacatcagttttac

SEQ ID NO: 64413 - DNA, 384 bp, Homo sapiens
ggaggccaaggcgggtggatcacttgaggtcagtggttcgagaccagtctggccaacatggcaaaacccctctctataaaaatataaaaaattagcggggcgtggtggcgtgcgcctgtagtcccagctacttgggagagggaggccggagaatcgcttgaacccgagagagggaggttgcagtgagccaagatcgtgccactgcactccagcctgtgtgacggagcaacattctgtctcaaaatcaaaaacacaaacaaacaaacaaaaagtgccttgggaatcacccttttaaaatatcaaacaaaatacctgtatttaatcagcagattattcacctctagaaatacaaatataatttttaaaataagtatttgctatgtt

SEQ ID NO: 64414 - DNA, 730 bp, Homo sapiens
caggcagcctcagcacaagaaaagaacatggtctagactgaagtaccaactaagtcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcactttgttaaaaccatatccaaggtttccctttatatttctttcaggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaag

SEQ ID NO: 64415 - DNA, 542 bp, Homo sapiens
caggcagcctcagcacaagaaaagaacatggtctagactgaagtaccaactaagtcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttaggggatatccattctggggctctgttttgttcattaattctggagccttcctaattgcagtgaaaagaaaaaccacagaaactctgatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaag

SEQ ID NO: 64416 - DNA, 474 bp, Homo sapiens
caggcagcctcagcacaagaaaagaacatggtctagactgaagtaccaactaagtcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttaggggatatccattctggggctctgttttgttcattaattctggagccttcctaattgcagtgaaaagaaaaaccacagaaactctgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaag

SEQ ID NO: 64417 - DNA, 627 bp, Homo sapiens
caggcagcctcagcacaagaaaagaacatggtctagactgaagtaccaactaagtcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttaggggatatccattctggggctctgttttgttcattaattctggagccttcctaattgcagtgaaaagaaaaaccacagaaactctgataatattgagccgaataatgaattttcttagtgccctgggagcaatagctggaatcattctcctcacatttggtttcatcctagatcaaaactacatttgtggttattctcaccaaaatagtcagtgtaaggctgttactgtcctgttcttgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaag

SEQ ID NO: 64418 - DNA, 577 bp, Homo sapiens
caggcagcctcagcacaagaaaagaacatggtctagactgaagtaccaactaagtcatctcctttcaaattatcaccgacaccatcatggattcaagcaccgcacacagtccggtgtttctggtatttcctccagaaatcactgcttcagaatatgagtccacagaactttcagccacgaccttttcaactcaaagccccttgcaaaaattatttgctagaaaaatgaaaatcttagggactatccagatcctgtttggaattatgaccttttcttttggagttatcttccttttcactttgttaaaaccatatccaaggtttccctttatatttctttcaggatatccattctggggctctgttttgttcattaattctggagccttcctaattgcagtgaaaagaaaaaccacagaaactctgggaattttgattacattgatgactttcagcattattgaattattcatttctctgcctttctcaattttggggtgccactcagaggattgtgattgtgaacaatgttgttgactagcactgtgagaataaagatgtgttaaaataaaaaaaag

SEQ ID NO: 64419 - DNA, 452 bp, Homo sapiens
gcactggcctcccggcggccttttgaggcctaagagctccaagccctgcccttcgtgccctctgcactagacgcgtggccacagccgacagtggatacctcatggcgactcagagtcctctctttaacctctcagctaccttcttctcatgacgttttctcggtaaaataagtggtgtggctcccctctcctgaccgggctgtgtcccaggacagagccggctggaaacgccccgcttgactggagagcactgcccgggctgctgcaggtgcccctttcacaggagctggagcgcgcctcaatgcagagatggtgtggctgggagggacttccctttcccagtcctccacttacatcacagggcacaagagccattggaaaagcatttagagaaatcatagcgaaaattttccagatgtggcaaaagacatacagctgcagatttaaaaagt

SEQ ID NO: 64420 - DNA, 379 bp, Homo sapiens
  misc_feature (379)..(379): n is a, c, g, or t
gacttaaaacatgttacatatttgagagtttctggaagaaaggaatcccttaaacatggctgtggcaaacacttcagaatgagttcacaccactatgactacaagaaatatgggaaggggctcagacacatgattgggggcttcagcctacatcagagaattcatagtggactgaaagggaacaaaaaggacgtgtgtggaaaagacttcagccttagctctcatcaccaacgtgggcagagtcttcacacagtgggagtgtcatttaagtgcagtgactgtggaaggactttcagtcatagctcccatcttgcgtatcatcagagacttcacactcaagagaaagcatttaaatgtagggtgtgcgggaaagccttcn

SEQ ID NO: 64421 - DNA, 945 bp, Homo sapiens
cttttataaaaccattagctcttctgagacatactcactatggacaagaacagcatgggaaaacccacccccattattcaattacctcccatcaggtccctcccatgacaggtggggattatgggagctataattcaagatgagatttgggtggggacagagccaaaccatatcaccacctaagttctctgtaaaaatagtttcagccaggcatgctggctcacgcctgtaatcccagcatgttggaaggccgaggcaagaggatcgcttgagctccggagttcaagaccagtctgggcaacatgacaagaccctgtctccacagaaaattaacattagccaggtgtggtggtgcgcatctgtagtcccagctactggggaggctgagatgagaaaatcgtttgaacccaggaggtcaaagctgcagggagccatgatggtgccactgcattctggtgtgggtgacagagcaagactctgtctccaaaaaaaaaaaaaaaaaaaaaaaaaaaaaaaaaaaaaaaatagttcagaaatctaagacagcactttttttagttactaagccttttattcagatagcacactaaattggggtcaaaaatctgctatagtaaagttctgtatttgtgtgtattgggtataaaaataagcgctttaattaatttgaaaatccctattcaccaaaagtttatactgtaataggggacaaaacaagtgcataaagctaaatttagccagtacatttataactgtttcattcagttgatcagagaagcatcacgattgctggaaaatatcggacctggattcaaggtttggcattgctgttttcaaagtatgtaatcttttagatcaggggtcagtgaactacagtacagagaccaaatctaccctgccacctgtttttgtgaataaagttttattgaaacagaaaaaaaagta

SEQ ID NO: 64422 - DNA, 434 bp, Homo sapiens
gtattattatctcagttttacagaaaaggtaactgaggtttacagagattaatttgtcccactagaccatagattccattaagggtaggaccctgtctaccttgttcattgctgtggcctcagtgcttagcaaagactggaatattgaaaaggctccataaataactactgaataaacacccaagaaccctggcagagccgggatataagcccaggtatatctagctccagtcacccacaccaccatatcagtcagctcccattctatggaaggaatgtaaatggaaggaagaaaataagcaatgaattacgctcataaatccaagattagaaaaaaaaaaagaaagccttaaacaataccactaaatatgaaggcatgatgtatagagttaaaatttgaaatattctaagaaagcatctccttcttaactaaa

SEQ ID NO: 64423 - DNA, 574 bp, Homo sapiens
agcggggacttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccggtgagcctggcgggggtcccgggagaagagtgggaggatctgaggaggatgctaattcccacctgggcgcagactgacagatgaacgggcgataccccggcatgggggtccacccatctgtccagttttctgccgtgggctccgacggcgctgttctccctggtcgagccttgtccattatcctgttcctttttctgcaccccaccccacccggctccactctctctggtgctgtaaatgcctctctcccgggtctctggctcctcccccaccacttctgggtctctgtccccgtctctttctggatgtctctgccccttttctctctgggtctccgtctccctctttttccagatct

SEQ ID NO: 64424 - DNA, 2965 bp, Homo sapiens
agcggggacttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggcaaaaaaaaaa

SEQ ID NO: 64425 - DNA, 2867 bp, Homo sapiens
agcggggacttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccactcccaataaaagctttggtgtataggcaaaaaaaaaa

SEQ ID NO: 64426 - DNA, 1117 bp, Homo sapiens
  misc_feature (23)..(23): n is a, c, g, or t
  misc_feature (29)..(29): n is a, c, g, or t
gttttttttttatatgggtcggngaaganagcagatcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggcaaaaaaaaaa

SEQ ID NO: 64427 - DNA, 1178 bp, Homo sapiens
  misc_feature (4)..(6): n is a, c, g, or t
  misc_feature (8)..(8): n is a, c, g, or t
  misc_feature (27)..(27): n is a, c, g, or t
  misc_feature (33)..(33): n is a, c, g, or t
  misc_feature (160)..(160): n is a, c, g, or t
  misc_feature (162)..(162): n is a, c, g, or t
gggnnnanggccctcaactagaagttncaaatntctcccaactctgttctgcatcttccagattggtttaaccaattactcgtccccgccattccagggattgattctcaccagcgtttctgatggaaaatgggggtttcaagtccccgattccgtgccnanttcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggcaaaaaaaaaa

SEQ ID NO: 64428 - DNA, 889 bp, Homo sapiens
tcgctctggaggctccccagatttccggcagtctaggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggcaaaaaaaaaa

SEQ ID NO: 64429 - DNA, 758 bp, Homo sapiens
agtataaagcttcgttgaaggctatctttaaaggagtacaaagtcttaaggagtggggtacacgaagaaaaagaggaggagaaggatgtacctcagttgaatgagtccagaggaaggctggatggttgacctttggctgggtgcgcagatggacgtgattctagtaatttggggcagtaataaccatgaagctgatttattgcaggtacctcatctgagagtgatggttattactgcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggcaaaaaaaaaa

SEQ ID NO: 64430 - DNA, 2127 bp, Homo sapiens
agcggggacttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctgtgggtaaaggtgtagttaatgcataattctttagcttcctt

SEQ ID NO: 64431 - DNA, 448 bp, Homo sapiens
gatgaatggacggaggcgttgaatggccctttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggcaaaaaaaaaa

SEQ ID NO: 64432 - DNA, 2569 bp, Homo sapiens
agcggggacttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcacttccggaaaggctgggtaccgagct

SEQ ID NO: 64433 - DNA, 2483 bp, Homo sapiens
agcggggacttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagacccaggagcctatgtgtagacct

SEQ ID NO: 64434 - DNA, 581 bp, Homo sapiens
agcggggacttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccagctgaactgggctttctgcaccaccacc

SEQ ID NO: 64435 - DNA, 368 bp, Homo sapiens
cctggtgcagtagcctgaataaagcatttccttaattgtctagtacattttatctttcagaaaaacaaagtcatccttaaattatttgttttctcaactaacatttgcttcacttgaaaccactgctcttcaagagcttggttagtattctggagcatgaggtctggagtgagtctcaaactctggctctactcttcatactgtgtaaccatgggcaagggacatgacctttttgtcttaatccactcacctataaatgggaatgatgggggtggtggtggtggtggtggagactacaacacagtgttgttatgaagttcataacaagtgccccattgttattatttgaaaaacaccttaggctcatc

SEQ ID NO: 64436 - DNA, 1691 bp, Homo sapiens
aggcgaggggctgcaaatgaggatggaatatgccaggctggcagcagacatgggcactggatggaggtgcactggtctcagatggctaggaatggataccagcccagtcaaggggatcattctgtcatggccagcctgacccagcatactttgccccctgggggccaccagatggggagagagagaaaccaaagactggaagatacaaaggcctaagttgtagaatggattccaagcagaaggcagaaggactcagaattggagaagcagccctttcactgagcctggggacagctgtcagggtaggagacaggacccaggcctcaggcaatgcctgccaggctagacatgagggatgctgcggcctctccccaccccatctccccaccccacccgcaactgccttcctcacaatggggttcattgttgaggtggtggggggcacctagggagggtgcagcagggggcctgcctgtcagacatccttggggagcctgccctttcaagcatgaatcataccaccagagatcacccagcttgctcttagctctgcctgcctggtgtagggtcctggagaccttcttggagctcatccagcagccatcatgcaaggtggtgctggggactgccctcttgctaggaggtggaggtctcatgctgtgggttcagagaaagaggagaagaaaggaaacctctgagtgtccatcagacaaggacaagtcaccagaatcccataaagcaaagaatgaaagctggattaaatcccactttagccgcctttccgaagagaagctggccctcgacaacaatgccagcgctagtggcaatgctacccagactgagagtgggagtgaagaggtcagctccacggttcacatagagaccttcaccacgaggcacggagaagtgggctccgctctgcaccgggaatccttcaccagcaggcagaagacatctgggccctcagtgatccaagagatccaccaggagtctggaaaagccccatccactgatgacgccacgtgggccgctgtggctgcctgcaccaaggagattgacacccaggggcggcacctggctcactccatgctgcagcgggccatagcttaccagcactcaggtcacctggagtccaaggacatcaaccaggaggagctgagggccctcgaggaggtagagatgaagctgcaaaagaatttcctcacccagcgggaaaacaccatagctggtgccaatcacacacacaccttctatggccacagtcaccacagtcaccatggccacccaagccaccagagccacagcctgcctaatcgcagacactagatctgtgacttcttggaagccacctaaccatggatggagacgcccctgcccccagcaaggctggctcacacacacgtctgttttctctcctatggggccatctatgcaggccagggtgagatgctgtgcccaaatccctactttcttaggctcctcacggggattatgggctctttaaactccatgagtggggtctgccacagaagatggcccctgttggagggagagctgggaggacacagcgcaggtgagatagaccctgaggcccctgaagacccaccaagagaagacagatgggagcaggcaagagccccacactgatgtcattgcctggaacggagccaataaagctttgtgtgccttca

SEQ ID NO: 64437 - DNA, 1241 bp, Homo sapiens
acattgctaacctgtaaagcactgtacggtcaacgggatggagcctgccctttcaagcatgaatcataccaccagagatcacccagcttgctcttagctctgcctgcctggtgtagggtcctggagaccttcttggagctcatccagcagccatcatgcaaggtggtgctggggactgccctcttgctaggaggtggaggtctcatgctgtgggttcagagaaagaggagaagaaaggaaacctctgagtgtccatcagacaaggacaagtcaccagaatcccataaagcaaagaatgaaagctggattaaatcccactttagccgcctttccgaagagaagctggccctcgacaacaatgccagcgctagtggcaatgctacccagactgagagtgggagtgaagaggtcagctccacggttcacatagagaccttcaccacgaggcacggagaagtgggctccgctctgcaccgggaatccttcaccagcaggcagaagacatctgggccctcagtgatccaagagatccaccaggagtctggaaaagccccatccactgatgacgccacgtgggccgctgtggctgcctgcaccaaggagattgacacccaggggcggcacctggctcactccatgctgcagcgggccatagcttaccagcactcaggtcacctggagtccaaggacatcaaccaggaggagctgagggccctcgaggaggtagagatgaagctgcaaaagaatttcctcacccagcgggaaaacaccatagctggtgccaatcacacacacaccttctatggccacagtcaccacagtcaccatggccacccaagccaccagagccacagcctgcctaatcgcagacactagatctgtgacttcttggaagccacctaaccatggatggagacgcccctgcccccagcaaggctggctcacacacacgtctgttttctctcctatggggccatctatgcaggccagggtgagatgctgtgcccaaatccctactttcttaggctcctcacggggattatgggctctttaaactccatgagtggggtctgccacagaagatggcccctgttggagggagagctgggaggacacagcgcaggtgagatagaccctgaggcccctgaagacccaccaagagaagacagatgggagcaggcaagagccccacactgatgtcattgcctggaacggagccaataaagctttgtgtgccttca

SEQ ID NO: 64438 - DNA, 332 bp, Homo sapiens
tgaaacagagtctcactctgttacccaggctggagtgcaatggcatgacctcactcactgcaacctccgcctcccgggttcaagcaattctccctgcctcagcctcccaagtagctgggattacaggcatgcaccaccatgcctggctaatttttgtatttttagtagagatggagtttcaccaggttggccaggttggtctcaaactcctgacctcagatgatccgcccacctcggcctcccaaagtactgggattacaggcatgagccactgcgcccagcctccatgggaaatttcttaatagaaacggggtctcccaggctgaagtaca

SEQ ID NO: 64439 - DNA, 365 bp, Homo sapiens
acgcgtgggcggacgcgtgggatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64440 - DNA, 416 bp, Homo sapiens
ctatacagtcacaactgcagtaggcagtgaggaagccagagaaatgcgatagcggcatttttctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccagccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64441 - DNA, 467 bp, Homo sapiens
gcacataaacacactcctactcgcacacactcatacagacacgacactcatacacacatacactcacactcacatgcagtcattcagatgcacacactcagacacactcatacactcagtcacacacatatacatagacatactcgtacacatacacacatacactcacactcactcacatatacatagacacatactgatacacacacatatacccattcacacacacacatagacattcatacacatatacacatacgcacacgtatacagacacacactcatacacatacccacacatatactcacacacataaactcacatgtatactcatacacatatacatagacacacattcactcgcacacatatacagacatacatacacacaatcacttgcacacatatacatagacacactcatacaatcactcacgcacatatacaaagaggcacagattgcagt

SEQ ID NO: 64442 - DNA, 438 bp, Homo sapiens
tctctaaacagaaaagaggagcagagccctgaggactggcgttcacagacagcgcctttgctctagaaggctcctcccaagcccccttgatcagggccttgacctgggccctatgggcctccctggcagcaggtgcaatgtttctgaaatggggtcaatgtttaaaagtctggaatttcccttaaaacccagattttgggtttgtcttttaaaatctgacatggtcttgatgctagaggagaaacatggcttgggggtccctgtcaacccaggccctccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64443 - DNA, 5667 bp, Homo sapiens
  misc_feature (1901)..(1901): n is a, c, g, or t
cagatcacttgagcccaggagtttgatatcagcttggccaacatggtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgaccttccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatccccccccaagaggngccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccatgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatccggggacagcgcccggcggcgtcgtgcaggccacagtctgggcattggggctctgtgggaggctcctctctttgccttgcagtagccatccgggggctactctgagcacgggcttgttctcacccagggccgctcccgacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64444 - DNA, 5615 bp, Homo sapiens
  misc_feature (1849)..(1849): n is a, c, g, or t
ctggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgaccttccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatccccccccaagaggngccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccatgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatccggggacagcgcccggcggcgtcgtgcaggccacagtctgggcattggggctctgtgggaggctcctctctttgccttgcagtagccatccgggggctactctgagcacgggcttgttctcacccagggccgctcccgacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64445 - DNA, 5272 bp, Homo sapiens
  misc_feature (1506)..(1506): n is a, c, g, or t
cctagaggatcccctgtgacgctccttgtgccagcagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgaccttccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatccccccccaagaggngccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccatgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatccggggacagcgcccggcggcgtcgtgcaggccacagtctgggcattggggctctgtgggaggctcctctctttgccttgcagtagccatccgggggctactctgagcacgggcttgttctcacccagggccgctcccgacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64446 - DNA, 3903 bp, Homo sapiens
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64447 - DNA, 3929 bp, Homo sapiens
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaaaaaaaaaaaaacaaagggcggccgct

SEQ ID NO: 64448 - DNA, 4277 bp, Homo sapiens
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaatatcctgtctgctccttcctccgggtgcagccctcaggattgtggctgtttcctgacccggagttttgccgctgggtggttggcggtggctcccgcaccgtggcagctccacggcctctgcctggcttccctctggggtcagggcagtgagcaaggtgagggctaacgagaacgggcagctcccagccatccctgtcagggctagttgtctggttggagggaagccacaccctccagattgggctctctcgtgaacaggtggttggggagcccagggcctccaggtttgtgagtagtcgctccggtccccatctctagtcctgatcatctcaaggcatttgctgagcacctgctgtgcgtcagtggaggcagaa

SEQ ID NO: 64449 - DNA, 3063 bp, Homo sapiens
ctggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64450 - DNA, 3738 bp, Homo sapiens
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcactccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64451 - DNA, 1936 bp, Homo sapiens
  misc_feature (19)..(19): n is a, c, g, or t
tatacgcaggctggtacgncccggagtttatgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64452 - DNA, 1410 bp, Homo sapiens
  misc_feature (14)..(14): n is a, c, g, or t
  misc_feature (20)..(20): n is a, c, g, or t
tccgttggcagtancctgcngtattgtagcgaggctgggtcgcgcttgtacaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64453 - DNA, 1043 bp, Homo sapiens
tagctagtacgagctgggtttgaatcggccgaggtcccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64454 - DNA, 544 bp, Homo sapiens
tgggtgtctagaggatccctgagagactgtgttgcactggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64455 - DNA, 235 bp, Homo sapiens
tccaggtgctgctggttgggtgggggcaagcagcaggttttccctgcccttctcctggcccccaggggttgagctggactgacccctggtatggaagcctggtaagttggaggcagggctaggccaggtgggtatggaggagccctcatatggcagttggcgagggcccagtgagcccctctctgctctccaggtggaccgggtcagctacctcctgcaggagatctatggcatt

SEQ ID NO: 64456 - DNA, 393 bp, Homo sapiens
tggctggggcagggtggccaacccaggcggccacgcaggggtgctcagaggcgccagcttgaccaccttaacctctttgtctttctcccctgcagcacatggacggcagcttctctgtgaagcctttaaagcagaagcaaattgtaagtcatcagaggaaatatgacgtgcttgaattaaaagacacacatatacaatcactcacacgcatactcatgcatagacacacactcatacacacgcacatatactcatacacgctcatacacactcatacacattcacttgcacatatatacggacacacatacataccatcagacactcacattcacacatatatagacacataaacacacagacacacacatacgcacataaacacactcctac

SEQ ID NO: 64457 - DNA, 6455 bp, Homo sapiens
  misc_feature (2689)..(2689): n is a, c, g, or t
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgaccttccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatccccccccaagaggngccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccatgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatccggggacagcgcccggcggcgtcgtgcaggccacagtctgggcattggggctctgtgggaggctcctctctttgccttgcagtagccatccgggggctactctgagcacgggcttgttctcacccagggccgctcccgacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64458 - DNA, 5884 bp, Homo sapiens
  misc_feature (5)..(5): n is a, c, g, or t
  misc_feature (2118)..(2118): n is a, c, g, or t
tccgnaccccagcggcagacgatgtctggttcactcagtgctcaatggtgcccaggctggagtgcagtggcgtgatctcggctcgctacaacctccacctcccagccgcctgccttggcctcccaaagtgcccagagtgcagcctctgcccagccgccaccccgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgaccttccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatccccccccaagaggngccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccatgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatccggggacagcgcccggcggcgtcgtgcaggccacagtctgggcattggggctctgtgggaggctcctctctttgccttgcagtagccatccgggggctactctgagcacgggcttgttctcacccagggccgctcccgacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64459 - DNA, 5386 bp, Homo sapiens
  misc_feature (1620)..(1620): n is a, c, g, or t
gtcctggcccagagcctggacggggctgaaggacacgggggacagggctcctggcttcttccgccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgaccttccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatccccccccaagaggngccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccatgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatccggggacagcgcccggcggcgtcgtgcaggccacagtctgggcattggggctctgtgggaggctcctctctttgccttgcagtagccatccgggggctactctgagcacgggcttgttctcacccagggccgctcccgacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64460 - DNA, 5499 bp, Homo sapiens
  misc_feature (1733)..(1733): n is a, c, g, or t
ggaattctcctgctgctcatcttcttctacattttgctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaagccggtacgtgaccttccagacgcgcttcgggggctctgacgcgcgtccttggagagaggagccctcccctgctctctggcgggggttccttctggtttttgggtcttcgtccgcatccgcatcttcccaggggccctggattccgaatccagagctctccagtggctgctgcaccttcccccagaaagtggcctcctggggggtcctgactttcggggccagaggtctctccatctggactaggcggccggtcaggctcttcttccagccttgaggggccctggaacagtcccagcccaggcagggagacagacacagcccaggtgcgccagagccactgtccactgcgggaggcaggagcttgagggatgagggcagcaccgtggagggaaccccagggagacatggggtgagcgtcccaaggggagaggcctgggcctggccttgttccggatggtcccaccatgagttcgcatcggtcctgcagcagacacgttaggacgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatcccccatccccccccaagaggngccctctaccagggtggcccaggtgagtgttttacagaaggcggctctgtccaggcagtggttcgcacctataagcccggtactttgggagaccgaggggatagatcacttgagcccaggaattcaagatcagtgtagaaaacatagaccccctctctataaaaaataaaaaattggcttgggcgtggtagcttgtgcctgtggtcccagctactcaggggtgctgaggtgggaggattgccggagctggggaggtcaaggcccactccagcctgagacgctgtctcaataaaaaaaaatacacacacacccacccacccactccagcctgagaccctgtctcaagaaaaaaaaaatacacacacacacacacacacacacacacacacacacacacacacgggggagagagagaaggcagctccaggagtgccaccaaaatgtaggcagacggattggggaccctctgccttcccagagggtcttggcacacaagctgcgtgcagctctggtctgccgaggcccatgcagcctgctgggaggtgcctggccgggggtgcaggctctaagaggccctttccccttgggtggacttgagccgggtcagggagaacttcgcttcttttgactgcgctctgcattcccatgaacctctgtcttcttgagcccagcgagtccctctgttgacccctgtcctgagccattatacccctagattgaaacagtcagcacctttcagacggccccggcctgcgcatcggtggaaggtgccatgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatccggggacagcgcccggcggcgtcgtgcaggccacagtctgggcattggggctctgtgggaggctcctctctttgccttgcagtagccatccgggggctactctgagcacgggcttgttctcacccagggccgctcccgacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64461 - DNA, 3993 bp, Homo sapiens
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaatagaaaaagctgtaaaacaaaatcatagggcaagaagtgaagacaaaaagtcttgcccaatggaccgaagatagacccaacaaaacttgt

SEQ ID NO: 64462 - DNA, 2188 bp, Homo sapiens
tgaagtgatctagagatcccggagttagcgggtgagacggccacggccgcacacagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagcccggtgctgggcctggccgaggggcggaggcacagctgcttccagcagccagcattcagtggccttgtcaccaagctccacacctcctcctggtgctggctttggtgacatcacaaggcccctccaggtgcaggggcttctgtttggcaggcccctgccagggaggacctggtggcctcctcattctcttttgccattggaatgtccccttgcagttctcttctcttttttttttttttggagatggagtttcactcttgctgcccaggctggagtgcagtggctcaatctcgggtcactgcaacctccgcctcccgggttcaagtgatcgtcctgccttaggctcctgagtagctggggattacaggtgcctaccagcatgctcggctaatttttttgtatttttagtagagaagggatttcaccatgttggccgggctggtctcaaactcctaaggtcatccacctgcctcggcctcccagagtgctgagattacaggcgtgagcctccgcgcccggcccccttgcagttctctctgatttggtttgttctgtctcaggcttctgtggcaggactggcccagggaggaggaagccagcagcacacctggggaatggggtcccggccgggaggcttggcctctgggcgacctcgtcctgttttgtttgtttgtttgtttgtttttttaaaggtaaacctcctgggccgcagatggcaaagggagtgcctgggcctggtgacccagggctggatccacccctgcggagccctgggccaggcaggtgtctgctgctcacctggctctggagggctgccctgcagctgggcctggggacaggtcggctgtggggcagctcagtaccctccctgaggctcacggtggctccgagcatgagctctgcctcctgggcgagacccagcagtggacagcacggtcctcacacccagctccctgcacacccaggccagccacccctcccgctcgtgcacaggcacgcagatgcgctcacacgtacacacacacaaatgcacgcccacttgcacatgctcacgcacacgttcacacatgcacactcacgctcacacatgctgtcacgcatacacacacgcacatactcctgcacatgttcccatgcatgtgtgtgcactcggaccgagcatctcccacgcacctctaccccaccccaagcacctctctccccccatgcacctctccccaacaacacacacagccccctgcaccgcccgccccccgcccccaccaaggccccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaa

SEQ ID NO: 64463 - DNA, 3006 bp, Homo sapiens
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggctgctccggaccccgttgtgagccggcctcctgtctgcatgccccctgtggccaccaggctccgaggggccgtggtgactcttgatcaaagagcacagtgaactgtcccttctgagtctcccttttctacagttgatatatttgtaactggtacaagatgaaggacagcagctttccatccctagttcagagcccccgttccccagggtcctgtgggctgagcggctggggctggggctgcccacgtgtggcctccgctggctctgcctgctcctgcaacagtgcggtccctgcccggagaactcaggaggcctgcagaagagaactgattggtggtcgaagcaccatcttcacagatgttcaggggcagtggggggctccaggcacggtcaatgaaggaaacagtgcctgtccacccaccctgcgtgtcactgtggcggcctggctgtcgctgctttttgtcctctgccgtgtttgcgcggcctcagtgccctccctggtgcgtctgcgctggggccctcagtgctcggggccttggggtgcatgggcgccgccctgggcagctagagtgtctcagccagcctctggccatcagtcctggtgccagagctttgcgtgaagttcgggccgcagagtggcccgctgggactcccatgtgctgccgtctgatgtgctcagatgggctcatcgttggttcgtttttactgtatatttatagtaataaaatcatgcagcaaatatcctgtctgctccttcctccgggtgcagccctcaggattgtggctgtttcctgacccggagttttgccgctgggtggttggcggtggctcccgcaccgtggcagctccacggcctctgcctggcttccctctggggtcagggcagtgagcaaggtgagggctaacgagaacgggcagctcccagccatccctgtcagggctagttgtctggttggagggaagccacaccctccagattgggctctctcgtgaacaggtggttggggagcccagggcctccaggtttgtgagtagtcgctccggtccccatctctagtcctgatcatctcaaggcatttgctgagcacctgctgtgcgtcagtggaggcagaa

SEQ ID NO: 64464 - DNA, 1010 bp, Homo sapiens
gacgagcgtccgtgcggcctggtccgggccatgtccgcgtgaggaccccgccgctgtcgccgctcccgttccggccctggcccctctgcccggcagcgcggcgcaccatgggctccattctcagccgccgcatcgcgggggtggaggacatcgacatccaggcgaactcggcctatcgctaccctccgaagtccggaaactactttgcttcgcactttttcatgggaggagagaaattcgacaccccccaccctgaaggttacctctttggagagaacatggatctgaacttcctgggcagccgcccggtccagtttccctacgtcactcctgccccccacgagcccgtgaagacgctgcggagcctggtgaacatccgcaaagactccctgcggctggtgaggtacaaagacgatgccgacagccccaccgaggacggcgacaagccccgggtgctctacagcctggagttcaccttcgacgccgatgcccgcgtggccatcaccatctactgccaggcatcggaggagttcctgaacggcagggcagtatacagccccaagagcccctcgctacagtccgagaccgtccactacaagagaggggtgagccagcagttctccctgccctccttcaagattgacttctcggaatggaaggatgacgagctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtaagtcatcagaggaaatatgacgtgcttgaattaaaagacacacatatacaatcactcacacgcatactcatgcatagacacacactcatacacacgcacatatactcatacacgctcatacacactcatacacattcacttgcacatatatacggacacacatacataccatca

SEQ ID NO: 64465 - DNA, 572 bp, Homo sapiens
atctgctccagtagaatgagttactttgtatgggatagaaggtgaaaaagagagaagaaattggcaacactcttagcccactgaaagcagcctgcttcagaacctaaggccttgtggttatttttactcgcttgcaaaagtgaggaaggatgttataggtctctttgagcctctttgcttttaccctttatttctatatgatctacatttatattaataaattattacatgccatataagttccagaatcattccttttgacagtcccatgggatttaatcccctcctaaatcccaaaatatagaaagagaaaatgtttgggtacagcactggggcatcatgcatactgaatattcaacaataaccatttgaatgagtggatgatttgggggtcattccttactatgtgactgctcttctctcaggcagtcttagtccctgtgtcactctcctagtgtgtagccgggctgctgcctgagtgtaatcctagcctttcaagataaccatttattatatggtgctgacccctaacaacacaagccagctccatcctctggtactcagcaaaaaaa

SEQ ID NO: 64466 - DNA, 2102 bp, Homo sapiens
  misc_feature (1119)..(1119): n is a, c, g, or t
gaagaaaaaggggtgcccaaacaagtcaccttaaaatttgatgcctgtgctgtcattaatagtaataagttaggaataaagtgtggttctcttaattagaaaagaggctatatggcagaaaataagtacatctgtcataaattaggactgtgtggaaataaatgtaaatactggtcttgtgtcatttaggccacttggattaaaaaaaatgaaaaggatccagtccaccttcagaaaggaaaaaaatggcccttcctgtgctaagggacaatgtaaccccttagagctagtaataaccaatccccttgatcctcgctggaaaaaagagtagcgtgtgaccttaggaatcaatggggctggactgaatccccgagtaaatatcttggttcgaggagaagtttacaaatgctctcttgagccagtgtttcaaactttctatgatgaactaaatgtgccaataacagaatttccaggaaaaacaagaaatttgtttttgcaattagccgagcatgtagcccagtctctcactgtcacttcatgttatgtatgtggaggaactgtaatagcagatcaatggccatgggaagcccgagaattagtacctacagacccagttcctgatgaattcccagctcaaaagaatcaccctgataatttctgggtcctaaaagcctcaatcattagacaatactatatagcaagagtggagaaggacttcacccttcctgtaggaagactacatggtggagttcaaaccacacagagaaaaatccattcagtaaatttccaaagttgcagaccgtttaggcccacccagaatcccaccgggactggacagcccccactgggctatactggatatgtggacatagagcctacactaagctgcctgacaagtagttgtgttattggcactattaaaccatctttcttcctactgtccataaaaacaggagaactcctgggcttccctgtctatgcttcccgtgaaaagcatagctataagaaattgaaacaatgataaatggccccctgagagaatcatacagtattatgggcctgctacttaggcacaagatggctcgtggggataccggatccccatttatatgatcaacngaatcatacggttacaagctgtcttaaaaataatcactgcaaccggcagagccttgactattctggcccagcaagaaactcagatgagaaatgctatctatcaaaatagattagctctcgactacttgctagcagctgaaggagaggtctgtaggaaatttaaccttactaattgctgcctacacatagataaccaagggcaagtagttgaagacatagttagagatatgacaaaagtggcacatgtgcccgtgcaagtgtggcatggatttgatcctggggccatgtttagaaaatggttcccagcgctaggaggatttaaaactcttataataagagttataatagtaataggaacctacttactgctccctcgtttgctacctgtacttcttcaaatgataaaaagcttcatcgctaccttagtataccaaaatgcatcagcacaagtgtactatataaatcactattgatctgtctagcaagaagacatgggtagtaaacatgaaacaactcctgctattgagtgagagtctcaaagtgggggaataagggaggagaccacccctcatattgtcttatgcccaatttctgcctccaaagaaagaaaaagtaaaaactaaaaggcagaaatgaaatccacaagcagacagcccgggcgccacaccctgggactggtagttgaaaatcaatcccggacctaatcggttatgttatctatagattacagacattgtatagaaaagcattgtgaaaatctcattcctgttttgttccaatctaattactggtgcgtgcagcccccagtcacgtacccacgtacctcctgcttgctcaatcgatcacgaccctctcacgcacacccccttagacttgtgagtccttaaaagggacaggaattgctcactcggggcgggggctcggctcttgagacaggagtcttgctgatgcctccggcctaataaaccccttccttctttaac

SEQ ID NO: 64467 - DNA, 318 bp, Homo sapiens
ggtgatttcactgtttaaaatggcccccaaaagcagtgctgaagtgccatgatgtgtcttaagaacaaaatacatgtgttagataagcttcattcgtctgagttatagtgctcttggctgtgaattcaaggttagtgcataagcagtatatattaaataagatgtctttcaacagaaacacataaaacaagattatgtgtcaattggttgttgaaaatgtgaccagaggcttgaaggaacctacacctgtatttcccctaggagcaatggttcagtatttgttaataaaacatttttttgcaacttgataaaacataa

SEQ ID NO: 64468 - DNA, 444 bp, Homo sapiens
atacacttccagagaaaattcagactttgagctggagtttatccctgatctgaagattggcttcaagagttgttcatcaagaggagtgaatcacagtcactaaaggcaccttcctgtgacattttggatggctcctggaataaatttctaccactgaggaaccttgctggtgaggcagaagtctctgtctccacagagaaaaagccaaaagaagggagttgtgcatctacttagaataagagaaaacggtttccagatggctaatgaatggttaggtttctccgtcacatggcaacaagtcttacttcctcaaatgctggttctaaggactactgtgaaatcctactattgagattcatctagatccaattccatctcattattgtggagatacggtgcagagaacaatacatgaataaatacaactggattctgctctactga

SEQ ID NO: 64469 - DNA, 435 bp, Homo sapiens
cggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccggtaataacgtcttagttattttcatggt

SEQ ID NO: 64470 - DNA, 248 bp, Homo sapiens
tggtggaacccacctgggcctgcaaggccgtgctatgcttgttactagctgtgtgaccttgggcaagttaccttactgccaggtgcttcagggtacgcctctctcaagtggggattgcaatagtccctaccttataagattgctgcaaggattaaatgagtatatatacacacacacacatacacagcgagactctgtctcaaaaaaaaaattttcacatatattatttcatacatacacacacaaaa

SEQ ID NO: 64471 - DNA, 7662 bp, Homo sapiens
ccttcttgaggaatggagcttcgcagaggttgcatttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcgtgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcacgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaatgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcacccctcagggggcagggagcggcgacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttggctgaccgagtcttccaactctccgcacccccagcagaggcaacatgcctccccacagcgctacatctccgagccctacttggccctgcacgaagactcccacgcctcagactgtgttgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggccccgcggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaa

SEQ ID NO: 64472 - DNA, 7342 bp, Homo sapiens
ccttcttgaggaatggagcttcgcagaggttgcatttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcgtgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcacgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaatgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcacccctcagggggcagggagcggcgacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttggctgaccgagtcttccaactctccgcacccccagcagaggcaacatgcctccccacagcgctacatctccgagccctacttggccctgcacgaagactcccacgcctcagactgtgttgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggccccgcggggaggaagagggaaaaggaagatggaaggacaccatgcaatagactcactggctcagaatggtcgtcctgttgtaggcctccccctag

SEQ ID NO: 64473 - DNA, 6139 bp, Homo sapiens
ccttcttgaggaatggagcttcgcagaggttgcatttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcgtgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcacgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaatgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatggtgcgtaggcccctcggccgccccagcggggcccagagcaaaggtctctggagttcccagggaagaggctggaattggagccacccaaatgcctgcctgttacagaaggaaaggagattcctcttgattgtggcccatagaagaggctctggtatcaagccagtcaccaaggacttctgtatcctcctttcccctctctttccttctgtgacagggttttccctttgtgggctggtctcatcatccagtcctcacctcagattatttgggctcagtcccaagagaactttccaataatctttttctgccaatggttagtggactcctttgagttatcagggggtttgacaagggtttttggccagctggacatctggccaccatgatcagtgactgtgttttctctttctcgttcctctcaacagatacagttggatataactctgaaattattttttaaaaaccaaacaagttgttcttccaactgttcccttaaatatttgtggatttttattacatggaactaaattaaatggtaggaattggtgaagataacttctttactgtctcttttgctgtttagtagttctgaagtgatagcgtgccttctaggctctagagcagggattggcaaactacatcccatgggcaaaattcagcccattgtctgtttttgcaaataaagttttattgaaagaca

SEQ ID NO: 64474 - DNA, 534 bp, Homo sapiens
gagccagaggttagtgaattaaaaagcgtgcagccctctaaccatggcatctaccttccttcggacacccaggagcatgcgggatctgggagggcatcttctatgccacgtctgactgtggatccccaggtaaaaagcaaccacctacattaatgcagtggcatccgggctgtattagctgggttatggaataatatctgatatttgcaggtgagccgttgacttgcccgcaccccttccctataaataaaacctggctcatgggtcgtctctaatagagcctgcttctccggtgttttcaatgaccccccctaaccacaacagcccagcgaacaaaattgcatacttcactccggacgggttaaacattctcaagattcaaccagccatgcaagaaatattttccaggattttctctgtgtacttctccatcctttttttgtttcctgactcctccagcacatatgcagttacttacacacacaggtctgtgtcaggactgtctgtcctaaccagtgcaggccacatctcatt

SEQ ID NO: 64475 - DNA, 517 bp, Homo sapiens
cggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccatatcctttcttgcccaccataactccctctccccctttgcatttcttcgggtgaaggggggtacctagcatggaatgtatcccccaccccttcctggtgccaatttgcccctttgctgaagcacactcttcggtgcatctaaggggcaagcttggtgccgtggagacccgtttgggcactagtgtttttcaaggtaagacttttggttttttatttttcctatgtggaaatctttagtgtccctgggtgcatccctttctgggctgggctttgtctgattcccagccccctccccacccctactcccttcacatgccgccctctacatagattgggttgccccaatgcttcctttc

SEQ ID NO: 64476 - DNA, 7605 bp, Homo sapiens
ccttcttgaggaatggagcttcgcagaggttgcatttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcgtgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcacgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaatgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcacccctcagggggcagggagcggcgacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttggctgaccgagtcttccaactctccgcacccccagcagaggcaacatgcctccccacagcgctacatctccgagccctacttggccctgcacgaagactcccacgcctcagactgtgttgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggccccgcggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaa

SEQ ID NO: 64477 - DNA, 7536 bp, Homo sapiens
atgcgtggactgagcccagaccgcaggctgcccgagcccgccccctgcccggctgcggggagccctgagcccaggtccgcgggccgccgccaacgccacgtcctggccctgccggaagaagaggcatggcggccccagcagtgcgctctgctcgaggccgacgcctcggacgaggtgggcatgctgccggcttccccgcgcgccgcctctggcttcgacaacttcttccaggtgcaggagggcgagggccagggctgggagggcgccatggcactggaggcgggctccagccctttcctgccggtgagccccgaggtcatgaagcggcggcgcgggggcctcatcgagcagcgcgacatcatcaaggcccacgaggcgcacaagatgcagagcaccccgcaggcccggcgcaaggaatgggagatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcgtgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcacgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaatgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcacccctcagggggcagggagcggcgacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttggctgaccgagtcttccaactctccgcacccccagcagaggcaacatgcctccccacagcgctacatctccgagccctacttggccctgcacgaagactcccacgcctcagactgtgttgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggccccgcggggaggaagagggaaaaggaagatggaaggacaccatgcaatagactcactggctcagaatggtcgtcctgttgtaggcctccccctag

SEQ ID NO: 64478 - DNA, 4020 bp, Homo sapiens
ccttcttgaggaatggagcttcgcagaggttgcatttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcgtgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgagcccaagccaaaccatgcatccctgtacctgcacgtagggttaagggct

SEQ ID NO: 64479 - DNA, 1104 bp, Homo sapiens
catttgtttttttttaatcaacttttattttagattcaggaggtacatgtacaggtcatttgtttttatttataaagaaaaatatatttagctctagattctatttaaagaaaaaataggattagcctttttataggaaagtgaacaaaataacaagctggtaggttaaattgttccaataataaacattccctgagcgtatgaccttattccatttgagaaataaggcagcaataagaaattgatgataaaaatgaggttcacactgaggcctgtgtgttgtcttccaggaccaggtctgcgaggtgtacccccaggagccgtagaaataatgtacccaatgatcgaagaagaacctcagatattgcaagtgaaagagatagtccggaagtacttccctgagacctggatctgggatttggtggtagttgagtaagttgtgtgttgcctggaatttagtttaggagagggtttgaatcctgctgtatgactgatgttatcctggattcctgatccttttagttctgctctgctcttttctggtaaatatttaggtttatagttcatttatctcataattaaacaatgctaattttttttctaatttagtctattgataactaagataatagaaagtaggatgctaccagccctcttaaataaaggaaagggaaggggaggggagggagattgaaagaaagaacaaaaggaaggaaagaatgaaagaaaagaggaagaaataaagggagggagggaaggagggagtaagggaggtagggagaaaaaaaactttaaacctcaccaggagcaccaacccttagatcaagtttagcatttaccacactaggttactgagttatcatgttctaggatcagccatgctttgtgttaaaaaaaaaaaaaaaagatttgcttatactcctcttctctgctccttcactagctcattaggtataagtgagctggtgaccaggtccctgaaaccatcacagagtggaaggccagcgcattctgcttgtctggaaccacagggtttggcctctctcctatcgtgtctcttcaagccttccagcctttcttcctagaactcacccttccttattc

SEQ ID NO: 64480 - DNA, 1736 bp, Homo sapiens
atgcggtgactgccgctgtcaacccgagcctgagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagtacaacttctaccctcgctcatggattctgcctgacgagttccagctctttgttgctcaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccaggtaaccattgccagttcccagcctgcgtttccagccttgaccggcctcaagagggctctctggcttcgtgtaggatgagtgatcggggtgggatggccagaggaggggacagtgttggtggtgctgtgggcttgggtgttaaacctgggcccaacttccaagctttctgtttgctccctgtgtgatttggggcaagctacttcccctctgttacctgtaaaatgaaatgaagaatacctatcttaaaaggttcttgtaagaattaaatgagataacacatgtaaagcagagttttacatt

SEQ ID NO: 64481 - DNA, 1615 bp, Homo sapiens
atgcggtgactgccgctgtcaacccgagcctgagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggcatgacggagatggtgcgtaaaattactctgagcagagcagtgagaaccatgcagaatctctttcctgaggagtacaacttctaccctcgctcatggattctgcctgacgagttccagctctttgttgctcaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccagattttaggctttgacattcttctaatgaaaaatctgaagcctatactacttgaagtaaatgcaaatcccagtatgagaatcgaacatgagcacgaactttctccaggggtgtttgaaaatgtccccagcctcgttgatgaagaagtgaaagtggctgtgatcagagacactctgcgcct

SEQ ID NO: 64482 - DNA, 1602 bp, Homo sapiens
atgcggtgactgccgctgtcaacccgagcctgagcgatcatggcaacgggctcgggcggggaacgcgtggcagcggctgcagcggcggcagtttggtggcggactggggcggcggagcggcggcggcggcggcggtggcactggcactggccccggccctgagcaccatgcggcggggcagctccgagagcgagctggcggcccggtgggaggcggaggcggtggctgcggccaaagcggcggccaaagctgaggccgaggccacagcggagacggtggcggaacaggtccgcgtggacgcgggcgcggccggggaaccggagtgcaaggcaggggaggagcagcccaaggtcctggccccggccccggcgcagcccagtgcggctgaggaggggaacacccaggtccttcagcggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggagttcccatttggccggcgcttgccttgtgacatctactggcatggagtttcatttcacgacaatgacatattctccggtcaagtgaacaagtttccaggttcaaatggtgaaagacgatgacccctcctggaagcccacttttatcgtgaaacctgatggtggttgtcagggtgatggaatctacctcattaaagaccccagtgacatccgcctggcagggaccctccagagcaggccagcggtggtccaggagtacatctgcaaacctctccttatcgacaagctcaagtttgatattcgtctgtatgtcttactcaagtccttagaccccttagagatttatatagccaaagacggactctctaggttttgtaccgagccatatcaggagcccacccccaaaaacctgcaccgcatctttatgcacttaaccaactattcactgaacatccacagcggcaacttcatccactcggacagtgctagcactggcagcaaaaggactttttccagcatcctttgtagactgtcttccaaaggcgttgacatcaagaaggtctggtctgacatcatctccgtggtgattaagacggtcatcgcgctgactccagagctcaaagtcttctaccagtcagacatccccacggggaggccgggccccacgtgcttccaggtaaccattgccagttcccagcctgcgtttccagccttgaccggcctcaagagggctctctggcttcgtgtaggatgagtgatcggggtgggatggccagaggaggggacagtgttggtggtgctgtgggcttgggtgttaaacctgggcccaacttccaagctttctgtttgctccctgtgtgatttggggcaagctacttcccctctgttacctgtaaaatgaaatgaagaatacctatcttaaaaggttcttgtaagaattaaatgagataacacatgtaaagcagagttttacatt

SEQ ID NO: 64483 - DNA, 381 bp, Homo sapiens
cggccgccgcccacgctgcccccgtccaagccgaagccggtgcagggcctctgcccgcacgggaagccccgggacaagggccgaagctgcaagcggagctcgggccacggttccggcgagaacggctcccagcggccggtcaccgtggacagctccaaggccaggacctccctggatgccctgaagatcagcatccgccagctcaagtggaaggaggtgaggcccggcccgacccggccgcgtgggcacagtggggtggacaggacgacctcagaggtctcggcacggcccaggtcaggtcggcgggcgagggctgagctcctgcggtgcaccacgctcgggcctgcttgtcagccgcaaagtgctcatccttcaaggcct

SEQ ID NO: 64484 - DNA, 1352 bp, Homo sapiens
  misc_feature (33)..(33): n is a, c, g, or t
  misc_feature (69)..(69): n is a, c, g, or t
  misc_feature (326)..(326): n is a, c, g, or t
  misc_feature (343)..(343): n is a, c, g, or t
gtccctcatctgcgtccggaaggaagtcatccncccgtccctcatctgcgtccggaaggaagtcatccncccgtccctcatctgcgtccggaaggaagtcatccgcccgtccctcatctgcgtccggaaggaatcatccacccgtccctcatctgcgtcctgaaggaatcatccacccgtttctcatcaggctgtgctggacggggcatgactagcgcttcctctgcaggctcatggagtatgttccgggctgtgagctcttcagctacctgcgcaaccgggggctcttctactctgcagagatcatctgtgccatcctgcactcnaaggagatcatctacanggacttgaagccggagaacatcctgctggatagggacggacacatcaagctcacggactttgggttcgccaagaagctggtagacaggacttggaccctctgcggaatacccgagtacctggcccccgaagtcattcagagcgagggtcacggaagggctgtggactggtgggccctcagcatcctgatattcgagatgctctcgggatttcctccatttgtgtgtgtgtgtgtgtgtgtgtgtgtgtgtgtgtgtgtgtgtgacaacatgtttggcatttatcagaaaattcttgcagacaagatagatttccccagacatttggatttccatgtgaaagatctcattaagaaactgctcgtggttgacagaacaaggtggttaggaaatatgaagaacggggcgaatgatgtgaaacgccatcggtggttccgctctgtggactgggaagctgttcctcagagaaaactgaagcctcccatcgtgcccaagatagcccgcgaaggcgacacctccaacttcggaacttaccccgagaatgactgggacacagccgcgaccgtgccacagaagggtttagaaatcttcaagaatttctgaggacaggagctcacatctggaagaagcaggaaggctggaatctgcctgcaacaaagagctgctcctgagcagaccagtagcaatgtcttcttcacgtgataaggacatttccacttttctgtctttgtgcctgtatgtatagaaacagatcagagcacagttgaaattaatgtaactggcattatttaagcaactggaattccacactgtaggaaggttttgaaaattgtttgcttgtagattttatcttatcctttagtgttgtgttcctactgtgatgtcttggtttttctcatagacttaagtttataagtttgaactggacttgttcaattataaccacaaattgtgtgtgtgtgtgtgtgtgtgtgcatgcgcgcgcctgtgtgtatatatagaagtcattat

SEQ ID NO: 64485 - DNA, 1497 bp, Homo sapiens
agtctgggcgtagagggtgcagggagcagacgggaggatctcaggccagggacgatggcggctctgcaggagaagaagacgtgtggccagcgcatggaggagttccagcgttactgctggaacccggacacggggcagatgctgggccgcaccctgtcccggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggcccccagagtggactgcgccttcctggaccagccccgcgagctcggccagccgctgcaggtcaagtactaccctcccaacggcaccttcagtctgcactacttcccttattacgggaagaaagcccagccccactacagcaaccccctggtggcagcgaagctcctcaacatccccaggaacgctgaggtcgccatcgtgtgcaaggtcatggcagagcacgtgaccttcaacaatccccacgacccgtatgaagggaaagtggagttcaaactcaagattgagaagtgaaacggtttgcgcaggggtcctgggcacgcctgcggggtcgctcaaggacaccctcctggttgggcttaccttgcccgtcagttccctgccaaatcatccccaaagtggtttggagcaacggtgttgtcagtgtgcgaactccagagaagcgcccacatctgaaggacctgctcgcgagtatcagttcttccttgttgaattcttacagtttttagatggaatttgctgctataagaatgtccagctaccatgggaacgcaaggcagcaactctctaattaaccaggtcataaaaacgattcgtcttctatgtagacatcactttcttactataatttatttttctacacttcaatatgaactgccccccccacattaatataaaaactactaatgcactgatatgaaacacggcttacactaatgacattctgaattcttgcttttaaaattgcaattcctaagttgtaaacataaaatatattaaagttactcttattgtatgtaaaaaaagaaatcgtgtttcctgatatgggagaaattaaataaaaaccaaacgcttccttaa

SEQ ID NO: 64486 - DNA, 117 bp, Homo sapiens
tttgaactgtctggatttcatggaagttggtaagatgcacttacatggaacattgttcatgccaaacaaactcatctttattgtatctatttgtcacataaatccttacatggaatg

SEQ ID NO: 64487 - DNA, 491 bp, Homo sapiens
aaaaaatagctgggcgtggtggtgcatgcctgtaatctcagctactcgggaggctgaggcaggagaatcacttgaactggggaggcagagggcagaggttgcagtgagttgagatcatgtcactgaactccagcctgggcgagaaaaaaaaaaagcctttagaaccaggaaagatctggatttgaattctagttctgccacagtatatctgtgcaaccctggacaagtcaattgacctcactgagcctcagttgtactcatgtggaaagtggggataaccctcagggactggcagggctttctgtgattatttgagaaaatgtatgcaaggcacatggcatagaatgaaggctcattaaaatatatagccaggtgcagtggttcatgcctgcaatcccccagcactttgggaagctgaggtgaaaggatcggttgagcccaggagttcaagaccagcctcagaaacatagtgaactccatctctacaaaaa

SEQ ID NO: 64488 - DNA, 137 bp, Homo sapiens
gaacattgagaagagatttcttggacatcgtggtttgcaagcttaatctttctttacatgtgagcaatttatatacataaatggcatgtgatattatatctgtaatttttgtttggatatttaaaggacaaaattat

SEQ ID NO: 64489 - DNA, 306 bp, Homo sapiens
actccagcctgggtgacagagtgacactccgtctcaaaaaaaaaaacttacaataatatgaggtctttgtaaaatgtgagaataaaacttttggagataagcgaacatctgagtaaattgaaatagcatgtctctgtacagaatattgtaaagatgttaggtaaatttattttttaaaatgttctatcagtaattccaatgtaatttttgtttaaaatttgatgaaattactgtgaagttatctgtatgaataaactaagcaatattataagttctgggaggtcagtaaattggcactttatgaaa

SEQ ID NO: 64490 - DNA, 275 bp, Homo sapiens
tttaagtggctttgaaaatggtaagacgtttatccttcaataatcactacttatgaaaaatataaaattttgacaacttgcacctgaaaaatttcaacatttagctgaagtctagttggaaagaagtcagtactgtaaggataccatactacttccagcaaaaaattgtggataacatttgagcagtttctagtgccagggactttatttgatcttcgcactcactctatgaagtagggaatttattttaacaataagaacactgaggctttgaa

SEQ ID NO: 64491 - DNA, 937 bp, Homo sapiens
ctcttctcagagggcatcttatcctacctgtgaactttcattatggggaagcaagacaggctcctccaacttgcaacccacatatgcaataatgtgatggacatctctctatgatgacacagcagacaccttcaggtcccaacatccactgccccgttgtcatccctcacacaagagatagcctgaccagacagggcttccatccagcagtgcccatgcctagatatacctggcgcaccgcacaacatcccagcccacacaaggccctgctacctccatccaacatactgctagactgaccctactgaatccacattcccacatattaccctgactcatatcacctagatcatgacagacaccagatgtggccttgaaccacacctctgaacctccaatctaccattctctcttgcctcctgactccaggcagggggctcacaagttagcagagcagggcctaacccaattacatagccatagactgctatgggttgtgtttctacagaagtcaaatgttgaagtcctaacttccactatttcagaatatgactgtttttgagatagggcctttaaagaggtgattaatgctaaatgggatcacaagggtggtatctaatccaatataaatgctgtccttataagaaaaggagattaggacacaaacagagaaggaccagtgaagacacagagaaaatggctgtctacaagcaaaggagagaggcctcagaaggagccaaccgtactgacacctggatctcaaccatctagcctccagaatggaacgtctatcctatgcctgcaccaccactgcattttggaagcacaaaacttgtctggttccatgcttcacaactgaagaagaattttgccttggaatgactcatacttcacctccctcatgcttgacttagatgcattcagatgagattttgat

SEQ ID NO: 64492 - DNA, 465 bp, Homo sapiens
atcagaaatgagaataatcagcgtaggagtctggatttaagcaaacgctggtgtgttttttatcctccaatgcagccaagcaagatcgccaacacaattaagcagctgtttaagagaaagcaacaaaaaagaagtccacttgcacccagaaaataaaatgggccgtttttcacactttattcctgttataattgttcattttcagtaggcccttagaagactattttaagaagagatttcatccagtatggtcagagagcagtgcttctccaccgccttccaggctaaaagttggcttttgttttaaacaacactcagggaaactgctacgtgactaggacgatggtggccaatgcaagtggcggcacccacctccccttgtgtgcagtgggaagagctgctctccttgctctgaggccacgcaaggacacaagggcaagggctcaatttcataggaggagggtc

SEQ ID NO: 64493 - DNA, 3655 bp, Homo sapiens
cagaaccaagtgataagagagagagagagagagagagtgccatacagaagctgtccattctgtgacctagccttggaagccagaccccatctcttccataatatcttggtggtcacacaccagcccaactcagcatggggagagacatcacaagggcatgagaaacgggagctggggctcatgagggctattgtggagtctggcagtcacaccagccttctctccattttcatctctttatcagccactcaaaatttctgccctgggctggtctggcttcctcatcctgtcctttccaaccttcctgtccatcctcttttttgagggctgccagagtctcaccccatcaattttattgctttgttctccttccagtccttttgttcgtcagactgctgactccctactcattctttttccttctcttcaaatcctagaatcccacccctgtggacctcgtttgcttcttttaatgctcgtcttcctgattctccatttttctgcttgaccccaacctatgatcttctgttccctctgtgcaagttcctcagagtctcttcaatctagctgataacttttcccataggaatatttgctatgcttaaatcacagcattttctttgggacagataggcaataaagagtagtaaatgtgtcatcagctaccagatggatgaagaaagcatttccctgaactttaattcatcattcatgttccagtttaagacttttaaggcaatagtaacttcaggcttcagagtcacagcacatctgtggacactgagggataaaatgtttcgtgttttgatgctgaagtgtatgcctggaggctctctgctgtgagcattcttgccggttgaaagaaggaagaaaaaagtacatttggaacattatccaacatcttgagattatgaactgtctgatgtgctgatattttatctgatgatgtctcctgggtctgctggtggtgaaagattttccagatttgtgaagtgtgatgaaagggctggtagtatctcatcctgactggcagagctaaaatgtaactcttcgaccttctgaacttgaacacttcttttcgaagctgtgaaatgtaaatccacagtagctgctgaccttagacatttttgcttttccctggagctttggcttttcttttgtaattaagactagttgataaccttcaatactaagaaactgaccacttctcattactccagagatggatggtgacttcatctttccatataattgattttgtagaacaaaaaccaaaagaggggctaagcagttttgaagtgccctaacaaaataagtcataatgcatctcacactttgaggacagtgatttgcacattgtagttgctcagtcaaatctggtgcacttgggaagtaaatgactcacctgggctgaagcctatctttctgaggatgcagggagggtttaccaagtaaatcagtgtataaataggatcaattgtaagaatttcatttgaatacaactggcatatgtgttaaacttaaatgccccattattcatgaaagtgggcccagaaattcttcttggtagtgcattataggtaactggatggagttaaagacttagagattgtcattgtggctgcttgtagtagcctccatagttataacagaagaggcagacacctctctcatcaccctggcatcctagaaatcagtgaaacctcacagtgaaagcatgcaggtatttttagcaagtaggcatggtcacaccacctgtctgttggtcacaatccagtaagccaacaccttactcgaaaggcttactcagaggggtgcgatgagattctctgctggttttggcaagccatgtagtcacctgtggtggtttctgtatttggaagaacaggaaagcagaagttgggctccacactgcccctttgatagactgtagagatggctgttgttttaagccatattcatgttcaggcagtggattctatttaacactgttaaccaaccacaagtcttaagtgccactgtttttgccaaacgaaaccaaatctaagcatgcagcctgtgttaccaccctctgggtgctgattccgattgttttcatatctcatactgaagtatttcaaattatcagaaatccaatatgaaaataataaaggtttctgttcttggatacattcctaattcagcatttataatactttacactggattttattctagttagtggaaacaatgttcctaatgttgaaaaaacccacaaaaatgccaatgatgcaaatctatttacaagtactatctagtgtatttttttttaaaaaaaaattcagtaaacttcagaagttacctttttaaagaaaaaatttatcttaaattctatttgaggaaaggctgtgaatttatcaatttgtgtatcatatgactgaattacaggaatgttactctagttatataatcataaaacatgttctagatataccatagtgtatattttgatcagcaagtctagaattaggtgacttcctttagttggttcaatagccttgcaggacttttctcataaacttagaggataggacagtgtgagaatcgccaagaagctcttgggctctggagtcagccctgggtttggattctgattccacatttgctgtggtgatgggcaagttatataacctctctaagctctgatttcttcacaggtcaatggagatgatgaccatacctaactcattcaatgcaaaatactcacttcatgacttggtacaaagtaggattcagtaaaccatgtgggtgtcctccttccttttcttacaaagacaagattgtttggctatagatgacttgcagtggttagagtgacagagtgaacttacacagattatggtagctgaacagttaattaaaattgctgccagaaacttcatccacagatgttctcaaccttggctgcatgttggatcatctgcagaccttttaaaaaatcctgatacctgagattctttaatcaacttgggattcagattgacaatagaatttttgaaatcttcctatgtgattctaagatgtgaggaaagaatggctgctttatagcaacaaccatatcctaaaggttgttctgttttagagtttaaaagtgcaagaattatcttggaggaaaagctttcctaagaaagttcttgctcaccaggagtttgcctgctggccaaattcagccaatcacctgtttttctgaataaatgttattggaacatatccatgctcatctgttcatatatggccgttttcatactccagcagcagagccaaagagttgccacagagaacctgtgacccatgaagcctaaaatattactttctggtctttcatagaaaatgtttctgacctgccgggcacgatggctcacacctgtaaactcagcactttgggaggccaaggtgggtggatcacttggggtcaagagttcaagaccagcctggccaacatgatgaaaccccatctctactaaaaatacaaaaattagccaggcgtggtggcacacgcctgtaatcccagctactcgggaggccaaggcaggagaatcacttgcacctgggaggcagaggttgcagtgagcagagatcgtgccactgcactccaccctgggtgacagagtgtctc

SEQ ID NO: 64494 - DNA, 135 bp, Homo sapiens
tttaactctgcttaaaatgaaaggctcaccctagttcaatcagaccttttcttgcacgcaaacaaagatgacttttgcccgctagaacaagcaagagaggagttctttgcacaggttgttaacacacaaagatca

SEQ ID NO: 64495 - DNA, 490 bp, Homo sapiens
acctctccatgatcccagtctggggctgccagctcacattcctggcagatggaccatctaggattttctgtagccagagctgaaatggggagggaggcaggctcactggccctcagaatagaaatcctggctgccaatgatcaaacacctactgtgtatggagtgtaacaacgcagctctgttattatcccacctttcgcaaacagtgaggctgaaagaggttaagtaacttgcctaaggtcacaccacaggcagtcaggagtagccagaaatccaaaccgagtgttctttctataatgatcaagtgccgcagcctcctccccagtctcccggcttccacttttgcccctgcaatccattccccacatagcagccaaagtgagcttttcaaaatgtaaattggatcacattattcatctgcttaaaatcctccagaagtttcccatcacactcaaaataaaattcagacttttcatcctggcatacaagg

SEQ ID NO: 64496 - DNA, 3970 bp, Homo sapiens
  misc_feature (1022)..(1022): n is a, c, g, or t
  misc_feature (1067)..(1067): n is a, c, g, or t
  misc_feature (1214)..(1214): n is a, c, g, or t
agtaggtataaactaaacctgggccatcaagagtctccaaggaaaacttgcaatgatggagtccctgttaaaggtcaaaaatctccccgaccctcaagatccagtgcaagtgaagcagccagttgtctggggtaaatacccggggtttgccatcccatgccaggaaaatgtaggacacggacacacgcgaggagtcgcgaggagtttaagagggaaggtttaataggcaaaagaaagagaaaggaaaacagctctctctctagtgagagaggggacttccgagagaaaaggggcagctggaggcagatgagccgaatttatagtccagcttgaggaggcggcgtctgatttacttaggactcacagattggtttgatcaggtgtttgtttacatagctgggaaggctggccgccccaccctaagcttattatgcaaatgaactctctcggagggtgccattttgtcggctccttactgcacctgtggctgacagagaagggatgatggggccgccattttgaacacgattggcacaactgccgtcatctatgtctgcagcccgattttacaggctgctctttgttagaaggaaaaatgatttgggcctgctttccattaaaagagaaaccttaccaagaacttcggtaacctcactgtctacctaagtaatttcttcttaactcctgtgtcacaaggaagttagaacctggggtttctgggctactaagagaggaagatgtgaaggactgattcacaaagtgaagaagtcagagggcagtcacctggggaaaactccaaggacagtttacaggatagaatcaagaattggccaggtgaggccaggcgccctggctcacacctgtaatcccagcactctgggagggcgaggtgggcggatcacggggtcaggagatcgagaccatcctggctaacacggtgaaacctcgtctctactaaaaatacaaaaaaacgagccgggcgtggtggcgggcccctgtagtcccagctactcaggaggctnaagcggcaggatggcgtgaaccggggaggcggagcttgcagtganccaagaccgcaccactgcactccagcctgggcgacagagcaagactccatctcaaaaaaaaaaaaaaaggccagtgtcggctggtctgagaaataaagagaaacagtacaaagagagaaattttacaactgggcctccagcggtganatcacatactggtaggaccgtgatgacaaccccgagctgcaaaaccagcaggtttttattagggattttaaaaggggaggggtgtacgaacagggagtaagccacaaggatcacatgcttcgaagggcaataaagatcacaaagcgaaggcaaaattagaattactgatgagggtctatgtcccgctgtgcacgtattgttttgataaacatcttaacaggaaacagggttcgagaccaaagaaccggtctgactagaatttaccaggctggaatttcccaatcctagtaagcctgagggtactgcaggagaccagggcatatttcagtccttatctcaaccacataagacagacactcccagagcagccatctatagacctcccccgaggaatgcattccttccccagggttattccttcctgggaaaagaattcagcgatatttctcctcgcacatctgtttataggctttctgcaagaagaaaaatatggctctattctgcccaaccctgcaagcagtcagactttatggttatcttttcttgttacctcaaaattgctgttactttgttctttttcagagtgcactgatttcatattgttcaaacccacatgttttacaatcagatttcatattgttcaaacacacatgttctacaaccaatttgtacaatagtggtcctgaggtgacgtacattctcagtttatgaagataataggattaagagattaaagacaggcataagaaattataagagtattagggaagtgataaatatccatgaaatcttcacaatttatgttcagagattgcagtaaagacaggtgtaagaaattataaaagtattaatttggggaactgctaaatgtccatgaaatcttcacaatttatgttcttctgccttggctccagctggtccctccattcagggtccctgacttcccacaacaaattaatgatatttttgtgtcaaagactagctgaaccctatgttgttcccggttaccaactgacataaataagtatgtttgtaatgagccttaaaatggttctatggagttgcccatgtaagaagcagccggatggcaaattagttattgtaatttgaagtgctcacagttataacttcctatataaggttcctacttgcaatttctgtttgttttctatattcacaatatcttaaaaggcatagactatctttccaagcctcacattatacatcactttaatttgctctggtgtaaaactgctaatttctttgaggtgataccacagaaccactaaattagatacgctgtatgccacatagcatatattttaagtcattttttaattaaaaaaaacaaaccttaaaatttggtgaaaatccattgtgtttgttatctattgctgcataataaattgccccaaaagtaagtggcttcaaacaataagaaacatttattttctatctctcttaaacacatacacacacacatacatacacacacaaacacagtattaatttgttattgttgaagttttaaaaagtgatttgtatgtcaaaaacaaaccccaaccttctctccttgccacccaaaccaaagaaggccagctccataacataaaagtgcgaggtgaagcagcaagtgatgatgaagaagctgcatcaagttatccagaagatctagccaagataattggtgaaggtgactacactaaacaacagattttccatgtagataaaatagctttatattggaagaagaggccatctaggacattcatagctacagaggaaaagtcaatgcctgcctggcttcaaagcttcaaaggacagtctgactctcttgttagaggctaatatagctgatggctttaagttgaagctaatcctcatttaccactctgaaaaccctctggctcttaagaattatgctaaatctactctgcctgtgttttataaatggaacaacaaagcttggatgacagcatatctgtttacagcatggtttgttgaatattttaagcccactgttgagagacctactgctcaggaaaaaaaagatttctttcaaaatattactgctcattgacaatgtagttggccacccaagagctctgatgcagagatacaaggagataaatgttgttttcatgcttggtaacacagtgtccattctgcagcctatggatcaaggagtgatttcaactttcaagtcttattatttaagaataaattttgtaaggttatagctgcaatggatagtgatttttctgacatatctgggcaaaatacattgaaaatcttttggaaagcattcatcattctagatgccattaagaacacttgtgagctgagcacggtagctcacacctgtaatcccagcactttgggaggccgatgtgggtggatcacctgaggttaggagttccagaccagcctggccaacatggtgaaaccccatctctactaaaaatataaaattagccaggcatggtgacacactcctataatcctagcactttgggaggccgaggcaggtggatcacctgaggtcaggagtttgaaaccagcctggccaacatggtgaaaccccatttctactaaaaatacaaaaattagctaggcctggtggcagaggcctgtaatcccagctacttgggaggctgaggcaggagaattgcttgaatctgggaggcagaggttgcagtgagctgagatcgcaccactgcactccagcctgggcaacaagagtaagactctgtctc

SEQ ID NO: 64497 - DNA, 678 bp, Homo sapiens
gatgggggtcttgctctcttacccaactggactcaaactcctgggcgcaagtgatcttcctgcctcacacaccctggtagctaggactacagggtgcacaaccacacccagaaaatcacacatttatccatgtgattatctgaataacgtccttctcaccccttttctccatgttattcctacaacccagcgcagtgcctgacataaataaaatgctccttagatatttgcttaattaatgaccataaatgaactatttattggatggatattccaaaaagtgtatcaacaatccattcccaacagttagacattgacactgactattgaacacgaaatctgagtggtttgagcctattttcctcatcactgttcatcgcaggtgggaaacaggcaagggccctcctcactccatcggtgagcaggaggcccccccagaaggctaggcataggcagcctgaccacgcgaccaagctcctcagctgtgcttccagcgcattacctccttctctacccaactaagtcttgtcactttctccgcacgctgcctgtgaatttgctgtgattttgagtcatcgaggtgccctgggtatcagccctaccttctgctccttattggaactgctagaaaatgccagcctgcttaaacatgttcatgaagcaccaaggtagggtcat

SEQ ID NO: 64498 - DNA, 399 bp, Homo sapiens
tcatcatccagtgctcccttgtactcaaacctgtcctatttagtagaacatttttgcctaggggtcgtcctctgcagaattgtgaggtgacactgtcttttacaccctgagttcccagggcatggttctaatagtctcttttcttaataaaagtaaacgaaatcactaatatccatatgttacttttctcctactgtgaacagatttaattattcctttgagaaatctctgatttccaaatcaattctgaaaccttcttgcctaggaagaaaatattttgctatcacatttattttaaggggagtggtccaccctgcctagggaggttcatattttcaaagaggcccttaggcatggacaatatttaagccgatgaaataaattattggcaaaattaaa

SEQ ID NO: 64499 - DNA, 369 bp, Homo sapiens
taataacgtatttcctcttcattttagattacatgttataataccatcaatctgaacaggagaaaatctgatataaatagtattttgctgaaataattgcagtgttcatggtgctcatatatattaaaagttttaagtgaaaaaatgaattataattgctatattatgttgataaaagaaatccaatggaatagtaataacagtatgacaaatttgaatattgttgtgcaagaaaagaaaaaaattcaacttcagttgtttcctccttctccattattgatatcatcttccactgctgtgatgcttccactaggagccacatatcttacccaattttaccttaaggataaattgtatggggttaataat

SEQ ID NO: 64500 - DNA, 259 bp, Homo sapiens
gaaggcctcagcacttactactaaatgattctttgcccttccataatatagttatcctgtggctgatgtgctttcaatgttgacactgagaaatttgtcattgtggacatctgactgccccatagccattccctcctccagaggacagcaaatgggccctgttttgcccagtttatttattattggttaggtttttgttcctcactactgtcagaatagtcattatttcccatgctgcctgagactcattactgccacc

SEQ ID NO: 64501 - DNA, 780 bp, Homo sapiens
ggcccagccacccaagccaacatttgaatcccctttacaacatccccatctggcaggtgtccagcatcagcatctctagggattagcagagttcttgacaatagaaaccagcttctcattgacaccaggatattgcagattgctatctctataccagtagttctcaaacttttgttcccaggagccctttattctcttaaaaattgttgaggaccccaaagagcttttgtttatgcaggatatgtcaatatttatttgttgtcttaaaaatacaacagtaaacccattacatgtcaatatagatatcatttttgatgaaaaataactatttaaaaattaatttaatggagagagtagccttgcaaatctccttaatgtctggcataataaagagaagactgctggattctccatttctcattcaatctgttgtgacagaacaggtgatggagcctgtggaaagctcaagtgcacagacatgggaggtaaataacttctctgaattcagaagttttgatctcacagacctcccagaagggtctcagggactcccaggagtccccagactacattttgagaactgttgctctcttatacaccaagggatgggattggtgatgtaaattggcagggactgcagtgaaagaaaaactagatgcaaaaaggggccaagaaaaatgtactcacatctatgatcaacaagtattgagtgtttactatgtgcccaagtggaaagcactgaagatacaggttgagtgtcccttatctgaaatgcttggg

SEQ ID NO: 64502 - DNA, 387 bp, Homo sapiens
agcccagtgactagcctcctaaaaaggtttcctcctttcttctcttttagccctaaagtttctcttccattttctttaaagggcttattttaattttattatttatttatttgagacggggtctcgctctgtcacccaggatagagtgcagtgctgcaatcagaactcactgcagccttgacctcccaagctcaagcaatcttcccacttctgcttcctgaatagctgggactacagtcacacaccaccacacccagctagttttaagattttttgtagagacaaagtatctctaagtcacccacgctggtctccaactcctaggctcaagtgatcctccagcctcagcctcccaaagtgttgggattacaggcatgagccaccaca

SEQ ID NO: 64503 - DNA, 5335 bp, Homo sapiens
taatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttttgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcaatatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgcttctttcatttgattaatttgggtttttaaagggctgtttaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctcattttacttcaagggcatactgtgtagtgctgaatttaatctgaaaatctgatgattttgaaaagaaaaacaagtttataaacattgtacagaagaaattaaatgtgtgtgatggaaatcctgatggtggagcacgttgaattttctgatatatagtgttattttcctgggatcccctatgccttctttgtatttcaactaataaaggaaaaaccctgtcattaaaactggtaagataataggatattctgattatacagtattactattcctatcccattttctgaccttttctcaatcactgtaaatttttattttctatttcctattgataattaaatatgtacataatatagacactgttgtatagaactaaatgaattgggttgctatgcttgagtgggtagtgaaatggaaatatttgatgaatactgagagttcctaaaatgctagagcaaatttccgagggaaaggggggcatcgtgtgtcttgggaaggttgcagcaggttgtttcttcaactccctaagaaatcattgggaaggactcaactgcaaactcgggatcagatacaaaatgggtctttccttcccctctcccccaaaaaataggagcactaaattttaaaatctactcaggtgacagttgctttgcaatgaaacttatcccattgaaattttcagtgttaaataaaaagagatttgtgatatttttaaatataaacttttacatcagtagtcagcagcctgacaattgaaatttggtaagtcgatatattttaaaatattttgctctccaaatagaattgtttttaaacaattgggaggttttttgttctttaaatatgttttaattgtcattgtaaaaacaaaatcttgcttgaccctatattatgccatgaatgaattgctgagcctttataatacagtgacagcttgtttcatgcatagtcatggaacatagagatgttctttaaactgacctattgataagaggtttaatgagtttcacggctttcaacactattgtcatatagttatctttgccatttggagtttataaaaccattttatgtattgtgatactaaaggaagttgttttgctttactttaaattgaattattagactaatatttgcaaattctgcattttaaatgtggacactggctgtttgaaaaataaaatatagaatacagttttatggataattttcgagctgaatttttcacaatattctgaaccaaataacgaatggtaaatatgcaaaaatcatggtgcatagatataaccgtaaagagaaaagaatttctgtgtggaattaacagttacacaaattgggtaacaattatcagggcctttattatagctttatgtggaatgttattctaaaatgcaagagtcaaatgttactgtcattgaatattttagacttgaaacgtgtttatcatagagcgaagaaaatatgtgttcttttctttacagataagactctgttaacccactgtcagcatacgtgggatttcttttcttttttctttcattagtggagatttgttttcatccatctaccaccttgccagtaccctagcttgtgaccagcgggatgcattgtaagaaagttgtctgtggttaggagtgcagtctgggtccatggaacaaatttaaactaattggccctcgcaatgatcagtcctaggaccctggccttattattagcatggtgctttaaccaattgtacataataataccactgatagtctactaatgcatttcctagatcccagtttttcttgaatgattaggaatggtggggagaggggaggggagatattctacatgatacttctccaatcttctaaagattataagaaaaaataaaaaattgaagtcacttgaattaatgtgtt

SEQ ID NO: 64504 - DNA, 5282 bp, Homo sapiens
taatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttttgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcaatatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgcttctttcatttgattaatttgggtttttaaagggctgtttaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctcattttacttcaagggcatactgtgtagtgctgaatttaatctgaaaatctgatgattttgaaaagaaaaacaagtttataaacattgtacagaagaaattaaatgtgtgtgatggaaatcctgatggtggagcacgttgaattttctgatatatagtgttattttcctgggatcccctatgccttctttgtatttcaactaataaaggaaaaaccctgtcattaaaactggtaagataataggatattctgattatacagtattactattcctatcccattttctgaccttttctcaatcactgtaaatttttattttctatttcctattgataattaaatatgtacataatatagacactgttgtatagaactaaatgaattgggttgctatgcttgagtgggtagtgaaatggaaatatttgatgaatactgagagttcctaaaatgctagagcaaatttccgagggaaaggggggcatcgtgtgtcttgggaaggttgcagcaggttgtttcttcaactccctaagaaatcattgggaaggactcaactgcaaactcgggatcagatacaaaatgggtctttccttcccctctcccccaaaaaataggagcactaaattttaaaatctactcaggtgacagttgctttgcaatgaaacttatcccattgaaattttcagtgttaaataaaaagagatttgtgatatttttaaatataaacttttacatcagtagtcagcagcctgacaattgaaatttggtaagtcgatatattttaaaatattttgctctccaaatagaattgtttttaaacaattgggaggttttttgttctttaaatatgttttaattgtcattgtaaaaacaaaatcttgcttgaccctatattatgccatgaatgaattgctgagcctttataatacagtgacagcttgtttcatgcatagtcatggaacatagagatgttctttaaactgacctattgataagaggtttaatgagtttcacggctttcaacactattgtcatatagttatctttgccatttggagtttataaaaccattttatgtattgtgatactaaaggaagttgttttgctttactttaaattgaattattagactaatatttgcaaattctgcattttaaatgtggacactggctgtttgaaaaataaaatatagaatacagttttatggataattttcgagctgaatttttcacaatattctgaaccaaataacgaatggtaaatatgcaaaaatcatggtgcatagatataaccgtaaagagaaaagaatttctgtgtggaattaacagttacacaaattgggtaacaattatcagggcctttattatagctttatgtggaatgttattctaaaatgcaagagtcaaatgttactgtcattgaatattttagacttgaaacgtgtttatcatagagcgaagaaaatatgtgttcttttctttacagataagactctgttaacccactgtcagcatacgtgggatttcttttcttttttctttcattagtggagatttgttttcatccatctaccaccttgccagtaccctagcttgtgaccagcgggatgcattgtaagaaagttgtctgtggttaggagtgcagtctgggtccatggaacaaatttaaactaattggccctcgcaatgatcagtcctaggaccctggccttattattagcatggtgctttaaccaattgtacataataataccactgatagtctactaatgcatttcctagatcccagtttttcttgaatgattaggaatggtggggagaggggaggggagatattctacatgatacttctccaatcttctaaagattataagaaaaaataaaaaattgaagtcacttgaattaatgtgtt

SEQ ID NO: 64505 - DNA, 3428 bp, Homo sapiens
taatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttttgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcaatatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgcttctttcatttgattaatttgggtttttaaagggctgtttaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctc

SEQ ID NO: 64506 - DNA, 1685 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64507 - DNA, 963 bp, Homo sapiens
aatttgaccacagattcagaattattttctctttaatcttttgttattaatacaaattctaaccaagtatagtcattcgtagaatagttactaagtatctctggtgtcaagcactgtactatatgtgaatcaatgaaacgttgtgtctgataaattcatataaaaataatacgccttgacagcgttcacgtggaaacaaaaacaaaactaaaaaagttagcagatagactgcaggtttttttgtttttgtttttgtttttttgcatggatctcactaatacatttatcttcctcgtcagtcacttgaaatgaaaatttgttgcgttctgtattatttatgtcagttaatatagttaacaagctagtgattattgtaaaagcaaactgctttttttctcttgccaacagggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcataggtatgtcctttttgcccatttcattatagtcaagtttgtttcttcctgtgtttcatatttattttcaaattaaattgaggttacagacaccttcctctccttcctcctctcactaagcttgtttctgtatgtctctagtctttggtttattgacttaaaatccagggccttgtttgtcaaactatctttgtcaaacttctgtcattgagaagccctcaataatgcaggaataattatatccacacagcttctgcttacg

SEQ ID NO: 64508 - DNA, 723 bp, Homo sapiens
agagggccggccaggtgccgcagacgcggggacgctggctcgctccctccctccctccctccgacgctatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagagcctagaacactgcctgacactgtaataatcatcaaaagcatgcatccactggttaggaaagctgttctacatcctcttgtgccaccaaccagacccacgccatggcctggagcaagtcacctaatcccaaatgcaaaaacagataatactagcaaggaat

SEQ ID NO: 64509 - DNA, 1857 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64510 - DNA, 1180 bp, Homo sapiens
agagggccggccaggtgccgcagacgcggggacgctggctcgctccctccctccctccctccgacgctatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64511 - DNA, 1351 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagt

SEQ ID NO: 64512 - DNA, 1944 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcatagagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64513 - DNA, 1772 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcatagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64514 - DNA, 1044 bp, Homo sapiens
agagggccggccaggtgccgcagacgcggggacgctggctcgctccctccctccctccctccgacgctgataagtgcccaagagtacaattgctgggtcatatgatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64515 - DNA, 1305 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataagtaagttactctaaataaagtgaagaaatgtggagatggttacagctaaataagttcccaatagcttgtttggctatttctcatatttacagtttgtgcagtgtgatcctaattttgtttacaaacaaacaaaacccacacaaacatggaaaaaacaccagaaaaacagattacaaaatattaattgtggctgtttgggttgcaggatttcgatgatttttcttacttgtccttttgatatatttcaagttttctaaaacattttataatcagaaaaacttattaaatataattttaaagtattttatttttatggctttttaaaggaatgtagttaaccttttgaattctatcaaagtaacttgggttttcaaaaaattagtgggtggcacacttagaaatgtcattttgaaacttgaaactaaccttctaattacttaatacagca

SEQ ID NO: 64516 - DNA, 1216 bp, Homo sapiens
agagggccggccaggtgccgcagacgcggggacgctggctcgctccctccctccctccctccgacgctgataagtgcccaagagtacaattgctgggtcatatgatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64517 - DNA, 1242 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcataggtatgtcctttttgcccatttcattatagtcaagtttgtttcttcctgtgtttcatatttattttcaaattaaattgaggttacagaca

SEQ ID NO: 64518 - DNA, 1170 bp, Homo sapiens
taaaaaaccccaagaacaagaaacaggagtgacttgctcagtaattgttgagtggcaaatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64519 - DNA, 1408 bp, Homo sapiens
aatttgaccacagattcagaattattttctctttaatcttttgttattaatacaaattctaaccaagtatagtcattcgtagaatagttactaagtatctctggtgtcaagcactgtactatatgtgaatcaatgaaacgttgtgtctgataaattcatataaaaataatacgccttgacagcgttcacgtggaaacaaaaacaaaactaaaaaagttagcagatagactgcaggtttttttgtttttgtttttgtttttttgcatggatctcactaatacatttatcttcctcgtcagtcacttgaaatgaaaatttgttgcgttctgtattatttatgtcagttaatatagttaacaagctagtgattattgtaaaagcaaactgctttttttctcttgccaacagggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaagaaacctcaaatatttgttgttaagtgatcttcctggagtaagagaaaaagaaaatcttgtccaagcctttaagacagcactgccttctctggaactaaaattacaattgaagtaaaataatgtgtcttatttcagtataaaggatcatttgaaactgttgattccaaacatcaactaatattatatagtcatcagtagaattataaggatgccatatcatgacattttagaagtggagagtgcatcatatgtagaaaataaatattcagacgtggctcattaatgttactaagttggaagtgagaatttatgaacattaattcattttaagaaaagtgcagccaggcgcagtggctcatgcctgtaatcctagcactttgggaggccaaagcgggcagatcacctgaggtcaggagttcaagaccaaccatggccaacatggtgaaaccccatctctactaaaaaaacaaaattagctgaatgtggtggtgcacgcctttaatcccagctactctggaggctgaggcaggagaatcacttgacttgggaggtggaggttgcagggacccgagattgtgccactgcactccagcctgggtgacagagcgagactgtctca

SEQ ID NO: 64520 - DNA, 1424 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatggagggcctagagcatgttgaaaaaataaggctgtgcaagtgtcattatatcgaggatgactgtttgctgagacttagtcaacttgaaaatttacaaaaaaccatattggaaatggaaataatatcctgtgggaatatcacagacaaaggcatcattgctttgcgtcatttaaggtagatgatcaaagccaaagtggaaacttgataatgctgttaaggtgaatagttagaatttaattgactgtgaggggtggtgtctttttttagttctaaaaaagataattttaaaaaatgacctcactttcatctgtaatattttaaaacagctaaaatgatcaaccttaatacattaatgttgta

SEQ ID NO: 64521 - DNA, 1412 bp, Homo sapiens
agagggccggccaggtgccgcagacgcggggacgctggctcgctccctccctccctccctccgacgctgtgagtagagaagctaggccccgagccgggcgggactagggtggtggttgtgttctgccctcgcccgtcgccaacgctgggctgactgaaaacctggccctttgggtcgcgcgtcttcgactttcaccgccatgcggacatggggccgtgggagaaactctgggcgggattacggtgaaaattcttgtttgggcgggccctgcggcttctttcttccggctcgccctcggccccgccctcgccccgcccccgcccccgctccagctccagccgggtcctcgctcggccccgcacgcggcccgcggtagacggagggcctgggcacccaccgtctccatcccggccccagcccagtcgagcgtccactagaagggcgctccctgtccggccctaatcctcgctcctcacggaggctctttgtcacagcgaagactgacagcccgcagtcttctggacttcttttatggggctcctggcggtgctattcattcagtcattgattcgtcttgtaaatatggagcgcctgctctgtactcgacccggcactgggtaccggaagaaccagacagctcggtttttgccaccatttataagtctgtgtccttttcttgagtactgaaccgagatacagttttaaatgtgctgtgcggtctctgagcagcgactcacctgtgcagatcaaatgatgctgtttggaaaaatttcccagcagttgtgtggcgtaaagaaactcccatggtcatgtgactccagatacttctggggctggttgaatgcagtgtttaataaggtggattatgatcgcatcagggatgttggccctgacagggcggcatccgagtggttgctgcgctgtggggccatggtgcgctaccatggccaggagaggtggcagaaggactacaaccaccttccaacaggccctctggacaaatacaagattcaggcgatcgacgccaccgactcttgtatcatgagcattggatttgatcacatgggtaactaccctatcgttttgctaatagaaaatgcagatgatttgcagtgaccattttgttgcagttgactcacgattatagtcataggtatgtcctttttgcccatttcattatagtcaagtttgtttcttcctgtgtttcatatttattttcaaattaaattgaggttacagacaccttcctctccttcctcctctcactaagcttgtttctgtatgtctctagtctttggtttattgacttaaaatccagggccttgtttgtcaaactatctttgtcaaacttctgtcattgagaagccctcaataatgcaggaataattatatccacacagcttctgcttacg

SEQ ID NO: 64522 - DNA, 493 bp, Homo sapiens
aagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacaggtagttactgaagtaactggaagcatgaacatgcccaccaggactcccagctcccaacgattcctgagcatgagcagatagtctctgaaagcatttccacagatgtatccacaactatagattagattctggtcctctgatattagaataaagtactaaaaattgtaaaaccttgaatatag

SEQ ID NO: 64523 - DNA, 2243 bp, Homo sapiens
aagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatctgcagactatcaccagggattcgcaagcagctttgagttctcaccgagccaggagtagaagcaacaaggccaccaccctcccagatgctcaggacacagaagcactgcaagaacgatgcacaatgccagatgagccattggtaagagctccagataaaggcacagattccccatcaccccctcctctcgaagagacttcaaatggaggaagaatgctccatgagtccctgaggcatgcagtacccattacaaggatgcagagcagtgaagacactgaggcaggcccagcctacagtgatgaggactatgaagaagacatcattgagcccaggaccttaaatgagatcaccacggtgacagacaaaactagcccttggtctagtgtcatatcagacacaagtgaggtcatcagccctcagcctgacgaggtgcagagggaaggcccctcttgtccttctccagggcctttctgcagagaggagcttatggtcaaaagtagctttctctccagcccagaaagggctgtcaacccccacctgcctaggcagggttctcctagccaaagtcttgttgcttgtgagtgtgaggcctctaaggccagggttggtggcgagtctgcctcagccaaccctcagcccatcccatgcccaacactctcaggagctcaacagagcagcacgtttgttggatggagctcaccacagacagatcagaacaaggagcccaagtcagaggccccagctgagaatgaagctgccaccagtgagctcggtgactctgctgatagcttcaagaagttgccgctaaatctagcctcccagagcagaagggaaaaccataagggaccacccatcgactcctctgacatcaggcagaggcaggtgacaactggatcagagacgtccacaaagcagagcctcctgctcccagggcccattgtggtgcccaacttctttttgcctccccagcagttggaggcttccctgcggatgctttcactctcagcaactttgccaccagcagccacaacagatcaggacaagagcgaagccaccaggggagctctctcccaaaggccttgtcgccccagacctaactcgctccccctcaacctgcctgaggaagaaactctcaggattgcacggatattttcttctcagtactcccagaaagactgacgcagcctgaggggctggggggaaggagacacctgcccaccctccgtcagctttgtccagcttgcaggaggcaccaggtctggctccttcagggctgtcacagtcctgaaaccaccacttgcctaggccacggatgcctcaagagacccggtcagcccagactggaggagtgccccaaaccagtccagtgtccacttgccagaatttcagctccttttttctgtggtgaggcaaaggctagaaataaaatggaatccgcgcccaagtgggacccaagcaggcatctttcggtggagaaacgccccccagtgtccttgacacagctgactgctggcatgagcccaccctctgcctgaagatgcaggaccatttttgccttaaaagttggggaggagggacatgtagattgtgtgcattgtgcatagtcaaggaaatcctagggccacctccagttcatttgtgtgggaacaaggatattttatagatacaaattatttttatgctgtgttgaattaatcaattaggagaggaaggggaaatcacttccttcaaactttttatctgattgtctaaaattctaaccatgcttttaacttattatttttacccagctctgaaggtcattgttcttgcctgtgtttgaataaaatcatattggtgtttgtaaaaaaaaaaa

SEQ ID NO: 64524 - DNA, 568 bp, Homo sapiens
aagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacaggtagttactgaagtaactggaagcatgaacatgcccaccaggactcccagctcccaacgattcctgagcatgagcagatagtctctgaaagcatttccacagatgtatccacaactatagattagattctggtcctctgatattagaataaagtactaaaaattgtaaaaccttgaatatag

SEQ ID NO: 64525 - DNA, 1320 bp, Homo sapiens
  misc_feature (1209)..(1210): n is a, c, g, or t
  misc_feature (1218)..(1218): n is a, c, g, or t
aagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatctgcagactatcaccagggattcgcaagcagctttgagttctcaccgagccaggagtagaagcaacaaggccaccaccctcccagatgctcaggacacagaagcactgcaagaacgatgcacaatgccagatgagccattggtaagagctccagataaaggcacagattccccatcaccccctcctctcgaagagacttcaaatggaggaagaatgctccatgagtccctgaggcatgcagtacccattacaaggatgcagagcagtgaagacactgaggcaggcccagcctacagtgatgaggactatgaagaagacatcattgagcccaggaccttaaatgagatcaccacggtgacagacaaaactagcccttggtctagtgtcatatcagacacaagtgaggtcatcagccctcagcctgacgaggtgcagagggaaggcccctcttgtccttctccagggcctttctgcagagaggagcttatggtcaaaagtagctttctctccagcccagaaagggctgtcaacccccacctgcctaggcagggttctcctagccaaagtcttgttgcttgtgagtgtgaggcctctaaggccagggttggtggcgagtctgcctcagccaaccctcagcccatcccatgcccaacactctcaggagctcaacagagcagcacgtttgttggatggagctcaccacagacagatcagaacaaggagcccaagtcagaggccccagctgagaatgaagctgccaccagtgagctcggtgactctgctgatagcttcaagaagttgccgctaaatctagctccgannaaggaacntagggcccctgctcttgatagggagggtgacatgtcacaatccaacacttgtccggcgtgggcctttgccccggggcccggattacaacacttcaccctata

SEQ ID NO: 64526 - DNA, 275 bp, Homo sapiens
ttgctcacttcccagatggtgcgacagacagggagaggcgctccacacttcccagacaatggggtcgccgggcagaggcgctccaatgggaataatttttaaccagtaaacaaaaaatacccattaaatggaaaggttttaggaccgaaatatgtcgttgaatgcatgagagcaaaaacccagcaggtagtattttctaggcattgtaaataacagtcgaaggcatctactaaagtgagttcacaagtaatatctatctacataaaacttctata

SEQ ID NO: 64527 - DNA, 1379 bp, Homo sapiens
gggagagagatcttcctctctcttcgggcgtgttaagacagcggggttggcctgtacttcctctggccctggctgaagagggctagtgaaaccgttaaacccctaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggtgtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagagggatgtggaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgtataaa

SEQ ID NO: 64528 - DNA, 511 bp, Homo sapiens
gacaaaccattgtcaagagggagggatacatgggacttttttgacttgattataagggcttaattttcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgtataaa

SEQ ID NO: 64529 - DNA, 1353 bp, Homo sapiens
gggagagagatcttcctctctcttcgggcgtgttaagacagcggggttggcctgtacttcctctggccctggctgaagaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggtgtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagagggatgtggaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgtataaa

SEQ ID NO: 64530 - DNA, 449 bp, Homo sapiens
gtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcaagaggagcccagaaacccaaactgtcaaggctcatgcaagagccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggagaaaacatcaagcaattttttcagtggattttttc

SEQ ID NO: 64531 - DNA, 169 bp, Homo sapiens
ctctgacaaattcattctggaaaccggatgggtcacttcagaaacccccacttcctggtgatgctcacacaggactccttcagaaccacttggtacccctcctctgggctcccactccactgcacacatgtggccccgtggcatctgtcacaccacaaggtcactgact

SEQ ID NO: 64532 - DNA, 896 bp, Homo sapiens
catcaacattcatttacgaattaccttttgaatgaagggctttgctgctagatccttcacagtctgcaaagtttacccctgaaatgggggagctttgaggttagaatgatctctatcctgaacaatattgctgggtttatgtttatttgggttttttttttttaattcattcctctctgtctttcaggaaatatatttgaggttcttttaaacacacacacacagacaaacacataaataatacagggttttttttttgtaattgaagaatggagttgatttgaaaaattgaagctggggtgagctacaatatgattttttaaaaatgagtaaataaggaattgtgaataatggaaagacaagtcaaagccaggaggaagataaataagccttgtggatgtggtcgctagaaaagagctacaaatttggctttatgttttctagcacttagtgttgctagaattttgtgatcaataacattcactttttaatataaaaagagaacaaaatttttagaaacattacagatttctgataagagacctaaaataaatttctctcatctgtcttcttaaagaaggcaccacagtgcaacaaagagtatcctcctataaggccattatcacattccttagtttagggtgttaataagggagatctcaaggggtcaataaatgtaggccattgctttaacccaagaggaaaatttcaagtatcactagacatgctctccaaagaaggatgcttgcaaaatggttcagtggagtatggaacgaaaaatatttgaatttatattcattttccccaactttttaaaatttatatttttgtgtatattttatgagtacagtagtgacataacatataaataaatatctattttgacaacttgtgct

SEQ ID NO: 64533 - DNA, 597 bp, Homo sapiens
gccgggtccccgttctggggctggtgatcctggggaagagccaggcagtgccctgcccacctagtggttatgagcccagaatgttgatttttttcccttggttgcttcatgactttgttgaatttccagagtatgtgtgggggcccccggcgtcccactcgccccagccctgtggcagcagagctggctgtcaagctcagtcagctgggcccagggccccggaggtaggtgggtgtgtgcctgagcttcccctttgggccctgccaggtgctgggagggaccacacaggcggcaggaactcggggtccccaggcctcggccacaccagcctggtgcttgttatatattgatatgtctctctacctgtgaaatgggtatttattttaaggagctgacgcacgcgattgtggggctgtcacgtctgaagttcgcagggcgcgctggctgtcaagagccgctgttgcagtctcgagtccaggctgtgcgctcaggccgggcttctctgtggcggtcctgggaattcctcctccgggcccttaggcgacactcccctgccttcagctgattggatgaggccctcatgccgtctgctgattt

SEQ ID NO: 64534 - DNA, 564 bp, Homo sapiens
tcctgccctctaaacaacaagcgtttcgccatcttgggcaattttattcccaagtctctctcttttttatttttgaggaaaggaaagaagtattaggaagtgtgtctggataagtctcaaagtttagggaatgttcagggggcccagtgacgtcatgtaaactttacggagaaattttcccaagagtaaattttttgcttaatttttctcctgttttataggattgtgtaacttacaggttactgataagttgtgtggcttatttttgtgttttgctctcaaaatcagtatacgaagtctgcgtattgtatgttttggtaacaggtggaagattatatgcaaaaaatggtaaaaaacttgtgcgtcatttgttatttatctggtttttgtgtacttttttttttaatttaaaggtttcaactgttatctgtagtcagtatattccctttcttatttgctccactctcccttatggattttttgaaaattagcttggttaatatttatgtatggttattttagattatctggctccccgtttctaataaaatgttctggggtttt

SEQ ID NO: 64535 - DNA, 248 bp, Homo sapiens
  misc_feature (36)..(36): n is a, c, g, or t
  misc_feature (50)..(50): n is a, c, g, or t
  misc_feature (63)..(63): n is a, c, g, or t
tttccccaaaaaacccgaagggaaggccgcgcggcngcccttatcaaaantcattttcccccnccgcgtgtgtcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtg

SEQ ID NO: 64536 - DNA, 114 bp, Homo sapiens
aattcaagcttctaacgatgtacggggacatgtgtaccccgctcaccacgggaacggccccccccaaccacaggcatcaggcaaccatttgaaataaaactccttcagcctgtg

SEQ ID NO: 64537 - DNA, 1104 bp, Homo sapiens
  misc_feature (20)..(20): n is a, c, g, or t
tcagtaactcccggggctangtacgaggcctgggtggtagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64538 - DNA, 1100 bp, Homo sapiens
agcaggctggtactggtcctggattttatggagtagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64539 - DNA, 1086 bp, Homo sapiens
cacttctcgctcgacacagcagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64540 - DNA, 1085 bp, Homo sapiens
  misc_feature (20)..(20): n is a, c, g, or t
tcagtaactcccggggctangtacgaggcctgggtggtagcagagctggaggtgggtgcccggcacggaggggcctgcggaccaatgggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64541 - DNA, 1102 bp, Homo sapiens
  misc_feature (6)..(7): n is a, c, g, or t
gtgganncaagagcgaaagattcggctggtacgggctgggtttcaggctagggtgggtccggaccgatgtggctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64542 - DNA, 1198 bp, Homo sapiens
  misc_feature (20)..(20): n is a, c, g, or t
  misc_feature (431)..(431): n is a, c, g, or t
  misc_feature (476)..(476): n is a, c, g, or t
  misc_feature (516)..(516): n is a, c, g, or t
tcagtaactcccggggctangtacgaggcctgggtggtagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcaggggggactagctagtccaacccggtgacccagtcctatgtgttgcctgcagcttgttggtgggcctgcatcgctgggcgctctgtctctggggccagaccccaccaggggttcgcttggtcttgcaagtgtccctgaagggtagagagcttgtgtgtgtccancaggagcaatttgacccgttgatggcgtgagtcagggacgcgatnggatgccaggagagcatcaggatcttattgagccagcgtnctgcgagattgtgttggacgcttgccgggctagacccgtgggtgaacgtggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64543 - DNA, 912 bp, Homo sapiens
  misc_feature (782)..(782): n is a, c, g, or t
tggtgcaggcgatgtatgtgctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcccttggctccttggggccccagggccccccccccaagggggttccgggcttgggttttggcaagggggcccccccaggaagtgctgttgaaggctttggggggggtttcccagccaagaacacaaatttgaccccttttgaaaggccgaaccaagggggagggggagttgacgacagtgaagcacgatgaacctttattagacacaacctgtccggcgggatttgtgtgggcacctttgccaatgggcgttgaaccccctttgcgggggaaacagggggcggaaaggccagagagggcacaacagatttttgtttttggggggaggaagcagcggcgagggggggggcgccgtgtttcccccagagagtgcgcccccccccaagagtgtggatagtgcggccggagtgtgggggttttttcccgccccccgccgtgtggtttttgcgggcgcggggcggggggctcttgttgggagatggtggagaactgggcccccatgggaaccggcacnccatgtgctagacgcagccggggacggggggcggagacactttggcgttccctccggcggctccccccgccatggtgaaccccagaggcgggaatggccgccaggggtggggggccaaaggttggcttgg

SEQ ID NO: 64544 - DNA, 1090 bp, Homo sapiens
  misc_feature (21)..(21): n is a, c, g, or t
tcgctaggtagagcatgggtntacagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64545 - DNA, 1090 bp, Homo sapiens
cattaggctaggtcgaggcttgtgagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64546 - DNA, 928 bp, Homo sapiens
  misc_feature (20)..(20): n is a, c, g, or t
tcagtaactcccggggctangtacgaggcctgggtggtagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtg

SEQ ID NO: 64547 - DNA, 1050 bp, Homo sapiens
tggtgcaggcgatgtatgtgctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaaacaaaacaaacaaaaaaacaaaaaaaagcaaaacaaaaacaaaaaaaaacaaaaaaaagaacaaaggcgaggacaacaaagaaaagaaccaaccagacggaggcacacacaatagagcaccgacaccgagatacatggacggcggcgggcggccctcatcagagcc

SEQ ID NO: 64548 - DNA, 783 bp, Homo sapiens
  misc_feature (20)..(20): n is a, c, g, or t
tcagtaactcccggggctangtacgaggcctgggtggtagcagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtg

SEQ ID NO: 64549 - DNA, 440 bp, Homo sapiens
catatctcaatttttctttcagggtcatacttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtagaggaattctgaagtccagcctttagagaacaacattcaagagggtcatatagactataaattaatgtcatgccctatatgtaattctgggtcttaaaggaaagattgtacttcaggagaagtaactctcaaatatttcatgccaagattttaagaatgttggtatttaagaaaataaatagtgatttggaaaatc

SEQ ID NO: 64550 - DNA, 693 bp, Homo sapiens
caggccagtaggctttgacttgtgccaccgcccacctacttgctggctgtgtgaccttggccaagttaccaagaaccgttctgagcctcagtttcctcatcaggaaaactgggacaataattccaatttaggagctgttggggagatggcataagacaataggtgtgaatcctggcacacagcagtcgctgaacagaagctgctacaatcacctctccttcacctgcctataatgaacctcgctgggattgagtttgggcccaggacctctctgacctccttatggttgggtcagactttggctgaacacctaccagctctgtgccaggggcggcgctggggaagaattaaaggttcgctttctattctacagtccctggcctcaagttcttggtgcccagcattctgcttgccagtatacagtccctgctgtataccggggggtttgcaggctgcagggatgcactggcaaatgagacaatgtctttgccctaagacaattcccagcctggagcagaaacgacctgaccactcagtgccaagacagaggaccttgaacagcccaggggttgaggagggactccccacaacagcccccttggggccccttttcatctttctaacacaccaggctcaaatattttaacagctctgtttcattcacagaataaagtgtaaaaaacccaatttcaa

SEQ ID NO: 64551 - DNA, 262 bp, Homo sapiens
  misc_feature (5)..(5): n is a, c, g, or t
gaaantatggccaagaaagggacaggagcacaaaacaaagagcactttcgggttctgatcgtgaaacctcgtgactcctaatttcctcttccccaagctcttggcaccttgtcctgagctggtcagctcagtctcatgaacacacagtccggtgccaggagctggcacgagaaactagcacacatgactcgtgttctcccgaaaggagagtgaagaagggtgagactccggccacagtggccacgttttggctgggtccgtt

SEQ ID NO: 64552 - DNA, 368 bp, Homo sapiens
aaccaaatcgtaaagaagcctaatgtcttgttgcaacatctgaaagaaacaagatgaatatattccactaggtgggaagcttagggtagtgggaagaacatggattcaggactttgagaaacatggatttaaattttgatccccaatgcctctctgcacttcactgttatctataaaatagaggaaataaaaatactatacattcaagtcttaacaccaacagttaactagttgtgtaaccttggacaagttatgtgacctctctgtctgagcattgtcatttgtatatgagatcatggaggttaaatgtccaacctgttgtcactgtgcacctcaaaataataaataaaacatttcatctctcaaaa

SEQ ID NO: 64553 - DNA, 549 bp, Homo sapiens
ctaactcaatgagcacagagagggtaagatgtcagacactaaaacagtgaggctgctttagtgatggtttgctgagatgatgcacacttgccatcgtgtagctccctgacaccatgaaatgtgtggtctctcatctttatattctctcatcagccctagtggaggagagtcagtgttggagcctgggctcttccttttatcttttgttttctttctctgatgaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaaaaaaaaaa

SEQ ID NO: 64554 - DNA, 427 bp, Homo sapiens
aaggagtatatgtttaatctgttttgttgtcattgtcaaatgcagtgaatatatcttggacctactggaaagtggaagagagaagtttttagtatttgcacaccataaggtggtcctggacgcaattacgcaagagcttgagagaaaggtgagctccctttgaaattcaccatgggctacttttgccatgtcccaagttgttctaagcaggcttaggtcagatccaagcaaagtgagaccgatggcttccggaagcattgctgaagactttctgaagaagagttcttgcttgtagaaccacagtggggtcaaaatgtttccccagccatgtcattttaacttcctccatgctccaaatagatatcccaggagtcttgctttaggaacatctcccaggggctgttccattattctgcataaataatta

SEQ ID NO: 64555 - DNA, 399 bp, Homo sapiens
tgtgttgaaatgaggcagcatttatttcctacacatcttccattagaaagaatattgaacctgatgatattcttagccctaaattggagtttttacaaatgagagggggcaaatgtttcaagatgggtgtttgcaccttgagagatgcagagatgtgaaaccgtaaacaagccgttgtcccataagaacaaggagggtggcctcattttcattagtctggtggttctgtgcaggttgtattcactgcagctcatttctccccaacaggcccctgattcaagagaagattaaagttctggcagaagccgggctttctgagaccaatttttcagaaatgacagaatccactgattacctctacaaggtaatgccagcacatggctcttcacccctggagca

SEQ ID NO: 64556 - DNA, 3070 bp, Homo sapiens
gtggcgcccgcttaccttgaggctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaaaaaaaaaa

SEQ ID NO: 64557 - DNA, 3169 bp, Homo sapiens
agcggtggcctagcccttcaggcctggccgctacaataaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgttgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaaaaaaaaaa

SEQ ID NO: 64558 - DNA, 2787 bp, Homo sapiens
agcggtggcctagcccttcaggcctggccgctacaataaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactgtgagtccagggctggagacagatttggaagcagacatgtctaggtgtcctttccatgagaggcccttgaaaatgacctggcattctctcagctttcctttctgtaaccttttccctcttccctaggcaagaacagcaagtccatttcattcctcagcctacctagtcagttttgaaaaatctcatattaagttgtggttttatacttgtatagatcgctgttgatggatggccataaagataagcacaggcaacagcagggtggtgatcaatattccgaatccctcaaagaatgtggaaattatgtctactatattttgagaatgcatcagtctagtaacagttgttagaaaattagtcctaacatgtttgatacatatgttaatcctttaaccatactgtgtcatttgtgttagtcaaaataacaagccgacattcttataaca

SEQ ID NO: 64559 - DNA, 3220 bp, Homo sapiens
agcggtggcctagcccttcaggcctggccgctacaataaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaaaaaaaaaa

SEQ ID NO: 64560 - DNA, 3175 bp, Homo sapiens
agcggtggcctagcccttcaggcctggccgctacaataaggctggcgaactcgcagcgcttgaatacccgtggcctaaccgtccactcggaagaccggtcccgctcgggaggctctgcagtcgcgcctggggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaaaaaaaaaa

SEQ ID NO: 64561 - DNA, 2794 bp, Homo sapiens
agcggtggcctagcccttcaggcctggccgctacaataaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaaggtgagctccctttgaaattcaccatgggctacttttgccatgtcccaagttgttctaagcaggcttaggtcagatccaagcaaagtgagaccgatggcttccggaagcattgctgaagactttctgaagaagagttcttgcttgtagaaccacagtggggtcaaaatgtttccccagccatgtcattttaacttcctccatgctccaaatagatatcccaggagtcttgctttaggaacatctcccaggggctgttccattattctgcataaataatta

SEQ ID NO: 64562 - DNA, 5724 bp, Homo sapiens
  misc_feature (1173)..(1173): n is a, c, g, or t
  misc_feature (1448)..(1448): n is a, c, g, or t
  misc_feature (4486)..(4486): n is a, c, g, or t
cgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagtnctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctnagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaaatgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcaggtaaccttaggaaaaataatctttaaaaagtaaccaagggcaatttgatttaactgggtagactgacacaacacttagagggctgtgatgtaaaatttttggagctaccagataaaaagaatgctaaggtacccctaagttgttcagtagttggacagaaaggagcttctcatgaaatttcatgaaattgaataaataaatatccttgatcttccctaaacctaccttacaccaagacccaaaccaatcagccttgtagaactcattttctgtagcttctttgaaataattatctgcagggatctggtgggaaattctttcctgtgaagagatgcaatgaagtgtggaaagattctagactccacactcagactggtgggaaaaccaanctccgccatgcagggctgtgtgatttggagcagaatgctttgcctctctgaattctgtcttctcatcatttgtatgaagacgtaaataatattcgtatttcagacttatgagatcaagtggtttaaggtacacacgtgcaaacgtctgcctggcacatgcaggtgctcagtgggagatctcccgcctcctccctcagccctcacccaggcctgtcatctggccttccacaggaggtcgggcagcccagagcaagccatgagtccacatcacatgctggctatgttagttcatttcctctgaagttacatgagaaaaatgttccttttctgtcagtcacgtcatccaggaaattatttcatccttttgtaacttaagcttaaattagacacagatagttaataggctagttatcatataataaaatatagggtgacttttataggagttacatgggtatcgagtattctagatttttgtctcttatattatttatgtatccttgtggcctttaaatgaatccctgtttccattcttgtttacagggttctagatcaaagcctcatttttccatttttggaatgctttaacagcttctaatttttccctatattcacagtctttcttctctgatcaatcttgcgtattcttcccacaatgtctttcttaagcaactccaatcttttgctttaagatatgcttagatatgaacagacaggacttaagttaccactgatttgaaaacaatgaaaaaaagccaacatccttagaagtctagaaatgcaaatttcagcaaaaaaagagaggaagaaagacaaacttaactgtcacattcatactgtttctttcaagttcatatttaaggaagtgagagctctcaaacattgctggtatcctggtaaaatctctttgaaaaataattggcaaaatgtatggtgattgtcaaaaatgttgctactctgggccacgtgcggtggctcacacctgtaatcccagcactttgggaggccgaggtgggtggatcacaaggtcaggagttcaagaccagcttggccaatatggtgaaaccccatctctactaaaaatacaaaagttagctgggcatggtggtgggcacctgtagtcccagctactcaggaatctgaggcaggagaatcgcttgaactcgggaggtggaggttgcagtgagccaagatcatgccactgcactccagcctgggtgacagtgagactccatctc

SEQ ID NO: 64563 - DNA, 3262 bp, Homo sapiens
  misc_feature (1173)..(1173): n is a, c, g, or t
  misc_feature (1448)..(1448): n is a, c, g, or t
  misc_feature (3222)..(3222): n is a, c, g, or t
cgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagtnctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctnagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaaatgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgagattgttttagaaaaccaacagcaaaacactgacaaggtacataaatacagattggacattttagggtaaattcactgtatttcctacttgcttgtaggaaaccgagtaaagtggaaaagctgtcctgatcatatggcatgcacaccagactgcaaaaggncgtccacactatttaacaggactgtggcaaaatagcttta

SEQ ID NO: 64564 - DNA, 342 bp, Homo sapiens
aaatatacagccttgtctataacagtccccttagaaggttcccagaaatttcttattttgatcttttcttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcaggtaaacctatgatcaagaaagagtgtctttccattttgtttatagggtcagtcctcttgtgtgagagttcttgattttcacaataatgtcttcttggagacagagttaaaaaaaat

SEQ ID NO: 64565 - DNA, 682 bp, Homo sapiens
ggcgtcactgcacttctgggcggcagagcaagactccgtctcaaaacaacaacaacaacaacaacaacaaagctgactgcatcttccatctgcataaaaatagcaagaactttcataattcttactctgtatacttctcaatgtttcacacatgttaactcacttaatccctgcaacaactttatgtgaggattactattataatctcctctttacaggtgagaactgaggcatagagaggttaaataacttgcttggagttaaactgctagtaagtgatgaagcaggatattaacaatttgatatatccctgcttattctgacagtcttgtctctggccacttgtgccttatactctatcctccagcaatggcaagctacatttcagtctcaccccacccgtattcactgtgcccccttgccatagttttgctcctgctgggagcctggcctggaatgccttccccagttgactcctttgcaaattcttactcctcctttcagaacttggccccagcatcacctcctccttctgtcagtcttcccacctggctctctgtgttgcccttgcattctgggtgcacctccaactattggaggggctgctttgtattaggtattagatggagaattgaaaccaagatctagaggtggtcctcaggattctatggtcatttaggaa

SEQ ID NO: 64566 - DNA, 408 bp, Homo sapiens
tttcaggatcagcgcgcctatgctgggcatggtgtggctgcaccagcacccctgtgagacgctcagagacacacggtccctccaggccagaatccgattctgcattttcacaggactcagtgactcacacttgctggagcaggagaagcaatgccctaaaaagtttcggcaattcacacatcaaaactctagagagttgttggaagtgggaaatgaacatttggggagaggctgagatttcagcaagacctcttgggaacttgccctttgtaattctaaagcggctttgctggcttctgaatgtaaacttgaatcgtgtgagttctgatccactcataacattaccgtgctttatgtactaaatgaaagtgcaatttgtttgtacactgattacagttttacccgctg

SEQ ID NO: 64567 - DNA, 1549 bp, Homo sapiens
  misc_feature (383)..(383): n is a, c, g, or t
  misc_feature (411)..(411): n is a, c, g, or t
  misc_feature (451)..(451): n is a, c, g, or t
  misc_feature (547)..(547): n is a, c, g, or t
  misc_feature (1531)..(1531): n is a, c, g, or t
atttctctcttctcacattttactataagcacataggaagagccaagctgcacctttaatactttgcttagaaatagctccagctaaatatgcaatttcatcacttgcgagtttcactttccacagaatcctagaccacaaatacagttcaacaagttctttaccactctgtaacaaggattgtttttccttcagtttctaataacatattatttctcatttctatctgagacctcatcagaatggactttacctcatattttaccaatagtctgttcatggttacttaggtattctttaagaagattgaggctttttctctagctcccctcttttctttctttgtttttgtttgtttgttttattttgtttttcaagacagngtcttgctctgttgcccaggctgaagtncagtggcgtgatcttggctcactgcaacctccgcctcccnggttcaagtgattctcctgccttagcctcctgagtagcggggattacaggcacctgccaccatgcctgactaatttttgtgtttttagtagagatngggtttcatcatgttgaccaggctggtctcaaactcctgacctcaggtgatccacccgccttggcctcccaaagtgctgggattacaggtgtgaaccactacacccggcctcctcttttctttctgattcctcaccagaatctcttttaaaaatgtttaaggcaatctaggctttttctactatgtacttcaagtattcgtctagtctccacccattacctatttataaagctgcttccacatttttaggtatttgttatagtaggaccccccattctcagtaccaatttctgtcttatgccacttgggctgatacaacaaaaatatcatggcctaggtgctttataaataacaaaaagttatttctcacagttctgaaaagttcagatcagagcactagcagattcagtgtctggtgagggtctgcttctctctgggtcctcatgttgctgaagggccacaggagctctctggaatctcgttaataaggttactaatctcattcatgagagctctgccctcatgacctaatcagctaccaaaggccccatctcctaatacgatcacattaaggattaagatttcaatatgagttttgttggggacatatgttatagcatcttcccatattgtgggcatttaggtggtttctatgtgttttttattaataatgccagcaggaacaaagttttccttattttatattatttatttaggatttgttctttgaaatagaattaacagatcaaagaatgtggacatttaaggcttttagtacatataatgaaattgctgatggcacagttgttttggaaagcaatagatgagagtacctgttttaccatggtcttaccagcattattataattttaaaaattgttatctaggtggggggcagtggctcaagcctgtaattccaaaactttgagaagctgaggtgggaagacttgaggccaggagtttgagaccagcctgggaaacatngcgagatcccatctctac

SEQ ID NO: 64568 - DNA, 384 bp, Homo sapiens
gccagcaagacagtgaggctgcagcagcatggggacagagtgcagaaagaggtcgcagaagccttggaagaacgtcattcagtcatacaaggacaccctgatgcttgcgctgcggtcctttccaagtccacggggcgttgttcctttgtgtcaacaccagataagactcatggggattgctgtcagtgttgtgtatgttataataccagggaccctcacatggctgtgttagattctaaccaatagaaaataataagtcaaagcaaagaccgttactgattccttccattgtttctttagagactttggtttagtgctctaaactttctgattatcagatcttatgtgtttgctaatatataaaataacaaattaggcataatg

SEQ ID NO: 64569 - DNA, 283 bp, Homo sapiens
aattcagacctaggctttccatctcccatgagcgtctgcttctagtcactcattttctcttccctgtctcatttggccttcttaatatctcaccccttgctaactgctttctccaatttctcacagctgagatttagaactcttgcagtatctttccattccaaatccttatagtaagaaggacaaattcattttttataaaatacaatgcacaaaatattaatcacaaatgatgaaaagtctccttcaagttcttacctcaaattcctaagccatcatgtgg

SEQ ID NO: 64570 - DNA, 1549 bp, Homo sapiens
cgtgcggcgcgcacaggcaggaggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaaaaaaactg

SEQ ID NO: 64571 - DNA, 1278 bp, Homo sapiens
tgtgcattctcttatgctggtgcactagagtcttgacctgcatcttaggcatagaagatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaaaaaaactg

SEQ ID NO: 64572 - DNA, 961 bp, Homo sapiens
cgtgcggcgcgcacaggcaggaggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtaccccctgccacccccgggatggctgcttccaagttgtttgcaattaaaggttctgtataaaaccaaaaaaactg

SEQ ID NO: 64573 - DNA, 1124 bp, Homo sapiens
cgtgcggcgcgcacaggcaggaggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcactctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaaaaaaactg

SEQ ID NO: 64574 - DNA, 543 bp, Homo sapiens
agacaagtaataagagaaatgacaaaggatcaaaattacaataattaaacattaaaataaatgttgtaataattaattatgataaataaactgggtagatttagaaggatcctttagccacctcctgtgaccttgtctctcactgccgcccctaacatttgctccagagctccagtacagtacagaaactgtttcctgaatgtcccacgtggtttcattcctcagggcaccaacaccagctcaaattgtccttatcctgtgtgtttgttttttttggttattatctgtttcttccactggaatgttggctctttaaggttgttcattttgctcactggtatattaaagtatatatacccacccctaaattgatgcccagcacatagtaactgcccaataaatatttgaatggctcaaaatggatcatacacctaaatataagggctacagctataaagtttttagaagaaaccataggaatatatttttgtgactttgagttaggtaatgatttcttagatatgacaccaaaagcacaaatga

SEQ ID NO: 64575 - DNA, 344 bp, Homo sapiens
gattacaggcgtgagccaccgcgcccagccattactctgcatttttaagcatgtacagtaaaaattcaatagtctttttgggccactgactttgtgtagttccactgtttggccagggcacacctgacaactctatcattgtaatgtttgaattgtacatactgtttttgtaaagtgacatctttctcccattccactaggtgtagcttaaaaataaaaaagtgacatttttcagatacttagcggctttttgtatatgcatacctttgatggtctgggcagtttatgaaagtgaacacaaagatttgagcctcttgatttacaataaatgattatgaattaag

SEQ ID NO: 64576 - DNA, 409 bp, Homo sapiens
gctccatctctctgccagttctccaagcaccagccacagccagtggccccagggggtctcactgcttttagtgttggtttgagaaatccatcgacctccctctggcattggtgtatctctgaggctatctttggaagcagtgaccctgtgctaatttgacatcttacctagagccagaagacagtgtgccacttgccagttttacagggaaaaagattcagaggaaaagtatttaagtacttttcacattgtatattgaagatatattaaagtggttttttttttaaggggaaacatataattattgtgtttgtcacatctagtggttgaaagctgctcttcttgttttctccaagtccttatcattttcttggtgggtagcagacctcacaggaggcctgtaccatta

SEQ ID NO: 64577 - DNA, 250 bp, Homo sapiens
cacttttctcttttggcttccaggttgctgttgagatgtctttatctgccagtctgttctctgcaggtgatgttttctttctgataagatgttttgtctttattatttgtggctttactataaagtgtgtaggtatgagttttaaaatttatcctgttttagaatcgcttgaacccaggaggcagaggctgcagtgagccgagatcacaccattgcaacttcagcctgggtaacagggcaagactccgtc

SEQ ID NO: 64578 - DNA, 517 bp, Homo sapiens
gtttgtttgtttgtttttttgagacggggtctcgctccttagcccaggctggagtgcatgctgcatgtttccatttatatgaacctcataatcgaacaaatctcatctattgtgacataagtcagaatactggtcttgtgatataaatcagaatactggtcagggagagaatctgggtcagagcacaggagggcttctaggatcctgatctgaatagtggttatatggctgtgttcaatgtaaaaattcattacgttgtacccttaaggattttgcattttgtgtgtattacacatcaaaaaaaaaaaagtttaccaaaaacaaagaaaaaaactaaagatgtccttttacctcttaccttcacagtttaactgatgctatccattacccttagcatgaattgactaacacccctaaatgaacactggtaggctaaaaggcaacactggcgtacacgcaggcttttctcttcccactatgcaatacttactaagagtctaatctatttgtggttcta

SEQ ID NO: 64579 - DNA, 481 bp, Homo sapiens
tcttaattccatggccatggaacaagtaaagacaacaccctgaggactggctcagcacataaaagatgacttttctagggcaccaggtttgatcccgacatttcctgagctcagttcacatgaggggctcacatccctgaatcccatccaggagccagctcctgagcaggggcaagggtcagcttgtgctggggctactgcttctagaatctcctctaacgccgcccttccaaacagccatctatgctgggtggagtgaggccacagcatgacaatcgtttaactgattcaaacccaccaggtgagcttggccaaaagggacatggtgggagagaaagaaacaaagaaaaccatgtaagcctgcaggaattcccgccaattctactctaggagcaaaagccccgagtggagttctagtatttgggatgcttttctttcatactaggttggtgcagaagtaattgccacctttaatggcaaa

SEQ ID NO: 64580 - DNA, 443 bp, Homo sapiens
ttgtgcacatgtaccctagaacttaaaacaaacaaaaacaaacattaattgtagagatttccacttctggtcacagtacagtagcagaaactagatttagggtattatgtgaaacaaccccttcaaagtagacagaatatatgaaacaatagattttaagacaaaaggcatcaggccacgaaacttagtaacctgtgagacagaaggcaaatgaggtattgcctatgattgtcccaggttacagtcttaagagagtttctaggctattgtactgggagggtgaacccagccagcacctgtcagactccctgatttgagaagacagagctgagagtctggggaaactcagtattctagagtttccacgacagagtactagaaaggagagacaactacacagtgagagaatgctggagatcttcagaggatccccctcgggtctc

SEQ ID NO: 64581 - DNA, 234 bp, Homo sapiens
gtttagaataaagatgaaacatttctcggaagagcatattcaggaatccatgtgaaattctcggagtcgggtctcgaattttgggggtcactgttaactgctgtttttagggacccatgttcttataaaatgtatcttgagctgaaatcacaattattttggtccataaagacttaattgtgtattgcttgtcagctagcaatgctggactgagttccgcagagggaatatata

SEQ ID NO: 64582 - DNA, 1362 bp, Homo sapiens
  misc_feature (2)..(3): n is a, c, g, or t
  misc_feature (355)..(355): n is a, c, g, or t
  misc_feature (1017)..(1017): n is a, c, g, or t
  misc_feature (1239)..(1239): n is a, c, g, or t
gnnggaaaactaagagagttctttgacaacagacccgtcctaaaataattgctacaagaagtttttcagacagatgagaaatgataccagaagttaacttggaatatcaggaatgaaaaaaagaccaacagaaatggtaaagatctgaggtaatgcaacattctgtgctgctcttgagttctttaaaatacgttttatggttaaaacaaaaattataacattttttgatggtgttttcaatgttatatgtagatagcacataagacaactacaacataaagagggtagaataaaagaaactaaagttttacattacacttaaaatggtaaaatattgattctaagtagaccatgnaaaggtaaagacgtatattgtaatccctggagcaaccactaaaaacaaaaacaaaaacaaacagaactatacaagcagataaagttaaaaacacaataaatgtccttaaaatggtagacacaaatccaaccatatcagtaattccattaaatgtaaatgatctaagaatggtatcagcaaaaatggaatagagaactccaaaactcctttttccataaaaaacagtgaaaaaaactggcaaaatcaactttattagaactctggagactaataaaaagtttaataaataaaataaattcttttttttaataaaataaattcttttttttttttttgagggagagtctcattctgttgctccggctggagtgcagtggtgtgatcttggctcactgcaacccccacctcctgggttcaagcgattctcctgcctcagcctcctgagtagctgggattacaggtgccctccaccatgcccagctaatttttgtattttcagtggaggcagggtttcaccatgttggccaggctggtcttgaactcttgacttcaaatgatccacccacctcagcctcccaaagtgttgggtttacaggcatgagccacaatgcccagccaataaattttaatcaagaagaaaaacggctaaatctcagtggganaacactgtggtgttttaacatacctgggctccattctcctctttcccagcttggtggcagccttgaagacaacagcctgcattcttgatataggttcttagtgttcgagggagcagaatggaacttactctcaaaggattgtggttgcctgttttgacctgtctgttggttccctgaaggatgagcacaaaagatttactttaatttcacctaacttagaantctcccagggctgaagcagctacctggggcatttggaaaaacaaacaaaccacacacacatgcacagagttaaaaacaaatgcattcactaatggtaacagttagggaaataatagacaaacc

SEQ ID NO: 64583 - DNA, 266 bp, Homo sapiens
gacagacacagaggacttatctgtgcaacagataatcggctccaaataattttttcaaagtgctctatttacccgagattatttgttagatgttttgtcgtgtaagttaatcaatacttgttgaattgagcaagcaacttcagaaggttatattccaggcgaaatatacacagactgacatttctttttcacttttctttcacttaaaaatagctttaaaatatttgttgacgcttgttactttttactacgctctatagaaacaa

SEQ ID NO: 64584 - DNA, 257 bp, Homo sapiens
cattttaacttaatcacctctttaaaagacctgtctccaaatacagttaaatttgaggtattgagggttaggacttcaacatgtgagtttgggaagggaagcacaaaatcagcccctaccatggtatatttatcattgatacattactatcaactaagctcaagattttattcagatttgactagtttttccactaaggccctttttcttttctaggatcccacagaggatacattacatttacttacatctcctct

SEQ ID NO: 64585 - DNA, 857 bp, Homo sapiens
aacgttggtaaggtgaaggtttcttgtgactgggcgaggacaggggctcccatgagaactggaactggaaattaactttgcacttggtgaagcatctgatgttttccagcaagatagttttggggacatgagagtaaacagaggtgacctttcagcacaaggctggggaatacgacactttaatttcctcttcttaagccctgaggaacttgaatgattggaacccactgctattggccacatgtggtgggggactgaagccaatgcatttttaagcctttggtcctggagaagtgggatgaaaatggttttctttggtggtaattgctttgggctctgctcagggagtaacacaagaagaccactcttctgtcagacacaaacccccgtgccccaaagctcattcaaaattgctacgccaggagatggatctgggatttaagttgccctcagtcctagctgcaattctctgcagcagagaatagcctgtttctattgccttatcctcacagatatgccagacagttcttaaataattgagccaactaaaaagatctaagtagaaatgaaaactcagacttatttttggtattttcagggtgtaaaatgttttcattcaaatgaaatgttttcattcttccctatgactttccactataaaaataattccaataacttaaaaactggccctccaatttggtgaaaagaccttggggcagggaagtctcaggggacagagacttggctatgccttcctcttgggggcactcagcgaggggccatacccacacgcaggtttccagtgcaggcttcttgatatcactgaagataaagagcgattaacgttcgtgtacccc

SEQ ID NO: 64586 - DNA, 625 bp, Homo sapiens
tggcacgaggaacctgtagattttccaaaattcactaaaatatgaaaggattgagtagtttattattcatactgagaatacttaatttatttttatctagagatgtttttatcaaaataagagcaaaaagtaaatacaatttttatccgtaaaaactctaaaatctttcaaaaatctgtttaaatctatatagttttatgttttgtatttcctacttatttagcagaaatgatgaagaaactgttctgatggcctgcttttctgtccttttcctactgctttaaacattgattttcttttgtactaaatcatatagccaaatattgtttaagtaagtcagttttaggaaatgcttgtgttgctgttgaattataaaagctgagtaaatttcagattaaactttaaatgactgtgaaataagacataaactagttaatggtaatttgcttaaaatgacttgagattattattggaagtttttattaattgatacaggtaagaattgatatttaataaaatgttctcatgcttagactatattacttttcggtagagaaattagtattttgctgtaatgtgttatgaaatacatgtgatatcctagtttgtctactgacactggggt

SEQ ID NO: 64587 - DNA, 4031 bp, Homo sapiens
attttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcat

SEQ ID NO: 64588 - DNA, 3969 bp, Homo sapiens
attttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatgcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcat

SEQ ID NO: 64589 - DNA, 851 bp, Homo sapiens
gtcctttaaaacataagccataccattgtggtatacaatcaggaaaattctgtatttatatatattttaacattttctattaacatttaatacatttgctcagagtaatgggttttctatttgcctataactaagcatgacacaatatttgatttcagaattgatgcatttttatttctctgttccactcacatgcagcaccatcaaatgccttcatgtaaccaatgtcacatctaatacttactagaataagattccatgtaatttgatttaaatatttaactttgagttcttttggtgttcaatctccttgctatagctattagcttgatgatattattttcagctgcactgcttaagctcaaaatttgaaatctgcaaatgtgctatctttctaagttcaattttaccattgtagatcatgatgtcatagcaatttcctgagtacccattttcagattcatcatcacattggtgacattgtggaaaaacagcctaggatctctcgagaacaactaactgatccctctccttccctaccctcgtcccaggcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatg

SEQ ID NO: 64590 - DNA, 3977 bp, Homo sapiens
attttaaatacacacacccacagggctctgccccctgtaaaagaaaaaaaatcaaaacaaacaaataaataaccccaaagagatggacccaggggagaacgcgtaagtgtgaggggcatgagtatacacgagtgtgcgtgtctttccctctcccttatttgtctccgtatgagtctctccttgtaccctccccctgcctcgatgatattactcccccagacttggaagccgctgccagagtgacgctttgatggtatctgcaagcgtttttgctgatcttatctctgccccctgaatattaattccctaatctggtagcaatccatctccccagtgaaggacctactagaggcaggtggggggagccaccatcagatcataagcataagaataatacaaaggggagggattcttctgcaaccaagaggcaagaggcgagagaaggaaaaaaaaaaaagcgatgagttcgccaaatatatggagcacaggaagctcagtctactcgactcctgtattttcacagaaaatgacggtgtggattctgctcctgctgtcgctctaccctggcttcactagccagaaatctgatgatgactatgaagattatgcttctaacaaaacatgggtcttgactccaaaagttcctgagggtgatgtcactgtcatcttaaacaacctgctggaaggatatgacaataaacttcggcctgatataggagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtatactgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcat

SEQ ID NO: 64591 - DNA, 3462 bp, Homo sapiens
aacagccagagagtaagtagaagctcatgaggctgaatgcttaggcctagcactggcacactcgcttttgtatatatattattagccgaagccaatcagatgatccagcccaaagtcgagaggcagaggaatagccttatccaggagaagtgaagccaacgttaattcacacagacatgtatgtgaatagcattggtccagtgaacgctatcaatatggaatacactattgatatattttttgcgcaaacgtggtatgacagacgtttgaaatttaacagcaccattaaagtcctccgattgaacagcaacatggtggggaaaatctggattccagacactttcttcagaaattccaaaaaagctgatgcacactggatcaccacccccaacaggatgctgagaatttggaatgatggtcgagtgctctacaccctaaggttgacaattgatgctgagtgccaattacaattgcacaactttccaatggatgaacactcctgccccttggagttctccagttatggctatccacgtgaagaaattgtttatcaatggaagcgaagttctgttgaagtgggcgacacaagatcctggaggctttatcaattctcatttgttggtctaagaaataccaccgaagtagtgaagacaacttccggagattatgtggtcatgtctgtctactttgatctgagcagaagaatgggatactttaccatccagacctatatcccctgcacactcattgtcgtcctatcctgggtgtctttctggatcaataaggatgctgttccagccagaacatctttaggtatcaccactgtcctgacaatgaccaccctcagcaccattgcccggaaatcgctccccaaggtctcctatgtcacagcgatggatctctttgtatctgtttgtttcatctttgtcttctctgctctggtggagtatggcaccttgcattattttgtcagcaaccggaaaccaagcaaggacaaagataaaaagaagaaaaaccctgcccctaccattgatatccgcccaagatcagcaaccattcaaatgaataatgctacacaccttcaagagagagatgaagagtacggctatgagtgtctggacggcaaggactgtgccagttttttctgctgttttgaagattgtcgaacaggagcttggagacatgggaggatacatatccgcattgccaaaatggactcctatgctcggatcttcttccccactgccttctgcctgtttaatctggtctattgggtctcctacctctacctgtgaggaggtatgggttttactgatatggttcttattcactgagtctcatggagagatgtctgttctaagtccacttaaataatcctctatgtggttgataatgatctgaatctgtttctatgtccaaacctggtaaattttataatgtcatattgtttgtgcccagccctcctttggttagtgtactttgaacttcgatgtttgctgtgtttcaaacctgcaaggcaaagtaaaattagagcaagaacattcaaaccaaataagatatttttcagctacagcaaataaaacagtgaaagccctgactatttacagtagtggtatccttactagattcataatgcaattagatagaaaaggtccaaaactgtaccctatgttcactccgggtcaagttgtgataaatttgatcccaatagaatacctccctcatttaagaaaaatcataactcactttaaatatgaaagcctagtccagaaatctattacacctttatctcaagataggaagaaaatttcctccacattcatgtacaatgatgtaaatatttcaataacttagaatgcttcaagtttagtgcatgcatctctttagatccaaaataaatggactgaagttatcatcctattgtcttttattttgtgtccttgggctataaaagattcctgaatgtaattataaggatttgggtttggaaatggagggaggaattttcattgccttctccctcatgcatgaagattcgaacagcttattttttccttgtatgacatattacaacactttaagtaaaatatagactggataatcaacatttgccacctctaaatatgcccaatttcataactagagtataaagtaattgtatgtgcttgccgctatttttttcttccttttaggatgatagatcataacagaacttattctccatctcaagatctgcttctagtgattgtgagtgccttgtgggcagaatccttgtcatttcctctttgggtctgtagcaccttgcatagtgcctggcatatagttggtgctcaataaatatggtttgaagtgaattgccctcacatgcttctggcaaatctctgtgctggcctgaaaccagtgactcatcttctcacataggtgttgtcaagtgatatttgattttgtaaaaataaccagtaggatccaaagaactttagctatttatgttcatcttcaaaaaattattttaggcaaagtccatactccttttaaaacaatatttatgtcctatgtttgtgtatagacatgactctactagggcataattagagtttgtgtattatttttccaggtttggggatgagtcagtccttgcccatccacaattttgtttgtgaacttataacaggaataagcaaaattcatacctgactagtgttcagaatgtagcattctgtgcgaaaaagtattgaagattagcttttaaaaactgaaaaaaaaaaatgaatgactcacatagaggttgagccaatgactgtggcctcattagattacattgtagttaaacaaagcaatttctccagacttaaaacatgatgagttgagctctatcttcatgtactcatcctgaatccttatttttctaaaatagcaccctttgttaattatttttatggaaattattactctgtcataattaaatcatagctagtataactttacagataacctaaaaagaatagaaaagaagagagagtggctttgtcagtataaaaccatgtaaagtcatcatcaagtcatctggatgaatcttgaaacacatttagctgccagttttacaaacctttaatatatcagtgctccagtatataacctcaaacaaatgtaaatagaacgaattattttcttgttttgaattgtcaatatattaaatgttgactctttgggagagttgttggcaagtttcaatggtgagaaacattattgtcaacttgaaatgtgttctgtaatggggacactacaaaaagctagctttccaatgtgtgcatagtattggcaatatgaatatatattatatataatctaatacttattataagctgctccctgtctatgtatttggaaaccttttcacaaagggaattgcctaacatgtggacttttacaataaaaatgctgcattctaatccatggtggcat

SEQ ID NO: 64592 - DNA, 1676 bp, Homo sapiens
cgggggtgtcccggctataaagcgtggccgcctcccgcggcgctcgggacagccgtaccccgggcggtcggacgggcgggcgccggtgggagctcgggccgtgcccgctgagagatccagagcgctccgttcccccggggccggagcgggggcgggtgggggcgtaagcccgggggatgctgggctcagtgaagatggaggcccatgacctggccgagtggagctactacccggaggcgggcgaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccgggcaagatgctgaccttgagtgaaatctaccagtggatcatggacctcttcccttactaccgggagaatcagcagcgctggcagaactccattcgccactcgctgtctttcaacgactgcttcgtcaaggtggcgcgttccccagacaagcctggcaagggctcctactgggccctacaccccagctcagggaacatgtttgagaatggctgctacctgcgccgccagaaacgcttcaagctggaggagaaggtgaaaaaagggggcagcggggctgccaccaccaccaggaacgggacagggtctgctgcctcgaccaccacccccgcggccacagtcacctccccgccccagcccccgcctccagcccctgagcctgaggcccagggcggggaagatgtgggggctctggactgtggctcacccgcttcctccacaccctatttcactggcctggagctcccaggggagctgaagctggacgcgccctacaacttcaaccaccctttctccatcaacaacctaatgtcagaacagacaccagcacctcccaaactggacgtggggtttgggggctacggggctgaaggtggggagcctggagtctactaccagggcctctattcccgctctttgcttaatgcatcctagcaggggttgggaacatggtggtgggtatggctggagctcacaccacgaagctcttggggcctgatccttctggtgacacttcacttgtcccattggttaacatctgggtgggtctattacttactgtgatgactgctgtctcagtgggcatggtgttgatccacggggtactgtgataaccaccatgtgccatgatggctgctgcagccccgtgttggccatgtcgtcaccattctctctggcatgggttgggtaggggatggaggtgagaatactccttggttttctctgaagcccaccctttcccccaactctggtccaggagaaaccagaaaaggctggttagggtgtggggaatttctactgaagtctgattctttcccgggaagcggggtactggctgtgtttaatcattaaaggtaccgtgtccgcctcttaaaaaaaaac

SEQ ID NO: 64593 - DNA, 1977 bp, Homo sapiens
cgggggtgtcccggctataaagcgtggccgcctcccgcggcgctcgggacagccgtaccccgggcggtcggacgggcgggcgccggtgggagctcgggccgtgcccgctgagagatccagagcgctccgttcccccggggccggagcgggggcgggtgggggcgtaagcccgggggatgctgggctcagtgaagatggaggcccatgacctggccgagtggagctactacccggaggcgggcgaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccgggcaagatgctgaccttgagtgaaatctaccagtggatcatggacctcttcccttactaccgggagaatcagcagcgctggcagaactccattcgccactcgctgtctttcaacgactgcttcgtcaaggtggcgcgttccccagacaagcctggcaagggctcctactgggccctacaccccagctcagggaacatgtttgagaatggctgctacctgcgccgccagaaacgcttcaagctggaggagaaggtgaaaaaagggggcagcggggctgccaccaccaccaggaacgggacagggtctgctgcctcgaccaccacccccgcggccacagtcacctccccgccccagcccccgcctccagcccctgagcctgaggcccagggcggggaagatgtgggggctctggactgtggctcacccgcttcctccacaccctatttcactggcctggagctcccaggggagctgaagctggacgcgccctacaacttcaaccaccctttctccatcaacaacctaatgtcagaacagacaccagcacctcccaaactggacgtggggtttgggggctacggggctgaaggtggggagcctggagtctactaccagggcctctattcccgctctttgcttaatgcatcctagcaggggttgggaacatggtggtgggtatggctggagctcacaccacgaagctcttggggcctgatccttctggtgacacttcacttgtcccattggttaacatctgggtgggtctattacttactgtgatgactgctgtctcagtgggcatggtgttgatccacggggtactgtgataaccaccatggatacattttggtggcccactgggtactgtgaggactgctacattgatggatgttattggctaatccactgcatggtttgatggccaccatctcggttggccctttgggtgtgatggtgatagcatttcagtgacatcttctttggccccccccattaggtgctgtgcccacttcttttttggtgtacttggcacagtaggtgccaagttggccaccattctgtgtaacaccttttttggcccattgggtgctttgatggacatcatactgggtaggtgacaacgtcagtgggccaccatgtgccatgatggctgctgcagccccgtgttggccatgtcgtcaccattctctctggcatgggttgggtaggggatggaggtgagaatactccttggttttctctgaagcccaccctttcccccaactctggtccaggagaaaccagaaaaggctggttagggtgtggggaatttctactgaagtctgattctttcccgggaagcggggtactggctgtgtttaatcattaaaggtaccgtgtccgcctcttaaaaaaaaac

SEQ ID NO: 64594 - DNA, 729 bp, Homo sapiens
gtcgagatgattgatccaatggtgagagtagggtgttgaagttcccaactattagtgtattggaatctctttctttagatctagcatttgccttaaatatctgggtgctctggtgttgggtacatacatgtttagaattgttacatcttcttgctgaattgatttttttatcattatttaatgaccttctttgtctcattttacagtttttgacttaaagtttgttttatctgataacaactcctgctcacttttggtttccatttgcgggagatatttttttccttccctttcagtctatatgtgtctttacaggtgaaatgggtttctggtaggcagcatataggtggatcatgtttaaaaaatccattcagctagtatgtatcttttaagtggggaatttaatccatttacactcaaggttattattgataggtgaggacttgttcctgtaattttgttcattattttctgttaattttatacatcctttgcttttttcttctgttcttgtttatcatgtggtttggtggttttctgtagtgacaacatttgtctccattttctttctcatttttgtgtatctgctgtaccagtgaattttatacttcagtgtgttttcatgatggtagatattattctttagctttcagatgtagaattcccttaagtattttaggactggtttagtggtgatgaatgaatgccctcagtttttgcacatttgga

SEQ ID NO: 64595 - DNA, 525 bp, Homo sapiens
cttgaagtttaatctcacatcgaatttgatatcccctcctccctccccttagcacttcaggagggtatggccagctccttcactctcccttccttgcctctgtctcctgggtccctgtgttgcagagttgaggtgaggggatgggagggcagagccatgtttacgtggggacggtgcagaagccagggtggccgtcgatggagatgcccaatgcgtgtgaaggccaaggctggcaggagccgtgggggagcccctggccagcagtgagcatggctatcttcagctcctgcccttttgggttggggttctgctccaaacagtgggtgggccagaggggctgggcaaacagaggctgtgctgttagttccctcagatgaggctgcccaggcaactggagcacttttggatggaacgagatactgcattggtgtattaaaagtctgattactgccgggcgcagtgcctcgcacctgtaatcccagcactttgggaggtcgaggtgggtggatcacttgaggtcaggag

SEQ ID NO: 64596 - DNA, 518 bp, Homo sapiens
attaagagaaaaataaatatataaactaaattatagttgatgtggtttggctatgtctccacccaaaatctcatcttgaattgtaatccccataattcccacgtgtgaagggagaggccagatgggggtaattgaatcactggggtggcttccccatgctgttctcttgatagtgagttctcatgagatctgatggctttgtaagtgtttggtagtttttcctgtattcattctccctcctgccaccttgtgaagaaggtgccttggttcccctttaccttcaaccatgactgtaaatttcctgaggcccccccagccatgggggactgtgagtcaattaaacctctttcctttataaattacccagtctcgggcagtttcttatagcagtatgagaatggactaatacagtagtttaaaagtatggctgggcattgtagctcacacctgtaatcacagctacttgggtggctgaggcaggaggacgtttgagtcaaggagttcaagaccagcttaag

SEQ ID NO: 64597 - DNA, 2042 bp, Homo sapiens
aggcatgtggatcttttcctaagcaagatgctgagctggaaagatgggggtgtaaggtaatgtcccaaactgaaactttgccaggcactgggagaggctgtgaactcttttctggctttagaatttaggtctagatcccaaaaggctaagtaccccctgggggctaaccagaggcatgcctgggctgagctgaaccttctggtgcactggcccctggctgactgctcttctgcaggaagttggaggagattcctgaagttgattcctcaggctggatgtccaagggggttggagtttctgatgtctttctgtctccctctcttttctttctctccctaccaggtccacttctttcagaggggcctgcggtgctctaaaagttctcctgttaaagtttagagcaaattggttattattttaaaatcaataaaacttttaaaagtactaagacaacttctaagaggggagtggacagagggcctggtggcagctcacagtttcttttctgacctttggtctcacccaccaagtgtcccacctgagtgcccaccttgcccacctgaggtaatgccctggggctccaccagtccagatccacagggcgcagccatgtgggagtggcggctgattgttacccagtagtgttgatagcacattattcataacagccaaagagaggaagcaacccaaatgtccattagctgataaatggataaatgaaatatggtacgtccgaagaatggaatatcattcacccatgaaaaagaacgaagtccagcaccaaaacgtgctacaacatggatgaacttcgatgactttgtgccacatgaaagaagaagccagccacaaaaggccatatattgtatgaaatgaaatgtccagaatgggcaaacccatagagacacaaaaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattataaaaaaga

SEQ ID NO: 64598 - DNA, 2578 bp, Homo sapiens
  misc_feature (4)..(5): n is a, c, g, or t
  misc_feature (10)..(10): n is a, c, g, or t
  misc_feature (12)..(12): n is a, c, g, or t
gaanncggcngnggagcgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatatt

SEQ ID NO: 64599 - DNA, 2124 bp, Homo sapiens
aggcatgtggatcttttcctaagcaagatgctgagctggaaagatgggggtgtaaggtaatgtcccaaactgaaactttgccaggcactgggagaggctgtgaactcttttctggctttagaatttaggtctagatcccaaaaggctaagtaccccctgggggctaaccagaggcatgcctgggctgagctgaaccttctggtgcactggcccctggctgactgctcttctgcaggaagttggaggagattcctgaagttgattcctcaggctggatgtccaagggggttggagtttctgatgtctttctgtctccctctcttttctttctctccctaccaggtccacttctttcagaggggcctgcggtgctctaaaagttctcctgttaaagtttagagcaaattggttattattttaaaatcaataaaacttttaaaagtactaagacaacttctaagaggggagtggacagagggcctggtggcagctcacagtttcttttctgacctttggtctcacccaccaagtgtcccacctgagtgcccaccttgcccacctgaggtaatgccctggggctccaccagtccagatccacagggcgcagccatgtgggagtggcggctgattgttacccagtagtgttgatagcacattattcataacagccaaagagaggaagcaacccaaatgtccattagctgataaatggataaatgaaatatggtacgtccgaagaatggaatatcattcacccatgaaaaagaacgaagtccagcaccaaaacgtgctacaacatggatgaacttcgatgactttgtgccacatgaaagaagaagccagccacaaaaggccatatattgtatgaaatgaaatgtccagaatgggcaaacccatagagacacaaaatggtggttgatggttgcacaacactgtgaatatactcaaaaaccactgaatggtatatttttaaaaaggatgaatcttaggaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattataaaaaaga

SEQ ID NO: 64600 - DNA, 368 bp, Homo sapiens
gcgataaaaaaaatgtcttgtgtttagatggtggttgatggttgcacaacactgtgaatatactcaaaaaccactgaatggtatatttttaaaaaggatgaatcttagggtatgtgaattatatctcaatttttggaaagggtcacctgatattggtctgtaactggcctcccctgtaacacctgcagctaccttcatgtgtggccttgggcaggtccttcagcaagtgggaccttagtttcatatcagtgaaaagaaggaattgagttgggtgaaccccaaggcctcttctgtctttgacactctaaatccttgtgttgtggggtggagtctaaagccttcatacttttttagttgcctacaatgga

SEQ ID NO: 64601 - DNA, 2890 bp, Homo sapiens
  misc_feature (4)..(5): n is a, c, g, or t
  misc_feature (10)..(10): n is a, c, g, or t
  misc_feature (12)..(12): n is a, c, g, or t
gaanncggcngnggagcgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattataaaaaaga

SEQ ID NO: 64602 - DNA, 3019 bp, Homo sapiens
  misc_feature (4)..(5): n is a, c, g, or t
  misc_feature (10)..(10): n is a, c, g, or t
  misc_feature (12)..(12): n is a, c, g, or t
gaanncggcngnggagcgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagcagatgctgggataggaagccgagggaaccgtggtttggagtcctctgtcccctgcagttagaagctggtcatagggacccctacatccggaggaatacctgaatcaaactttccttgagaaatgagagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattataaaaaaga

SEQ ID NO: 64603 - DNA, 423 bp, Homo sapiens
tgcccacatgactgctgaatgctggaaaccttacccagctcccactgtgcagacagcagtgcccacctccgctcctcggtgcctcccacctccccacccagaataacgcggcggtccctgtgcttgtcccgcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactc

SEQ ID NO: 64604 - DNA, 504 bp, Homo sapiens
tgcgtccctaaagatctttgagcatcacccttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatgctcaaagatcttgggggtaccgag

SEQ ID NO: 64605 - DNA, 6078 bp, Homo sapiens
  misc_feature (797)..(797): n is a, c, g, or t
gctgccctccccgtcagccgccctcgccgccgcggtgcgctggctgcaggaagccgccgcgccgccgcttttgttgtcagggacccagcgaggagcgccgctcgccggccgccgccaccctctctcgctgcagcctgctgtgcgctgcacggcctggggcccgggcgcccccgcgtctgcccatgagggggccccgcgaccaccgctgcttccagcccggggcggcgcggcgctgaggcggcggcggcggcggcctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgnctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaacatgtattttagagttcatctttggcaaaatcttgtggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctaaccaaaaaaaaaaaaaaaaaaaaaaaaaaaaaaaaaaaaaaaaaaaaaaaaaaaaaaaaaaaaaaaaaaaggggggggggcgccaaaaaatatccccccggggggcgccccattcgcgcccaccctttttttgtgaaaaagggggcccccatggggggtcttattaaaccaggggggggcgcgctaaacaggggggggggaacaactacgcctgtggggcacttgtggggaagacgaggcaccccctacactcggggggggggccgaaacaatgggggggcaaccaccactccagaaagttatgtaagacgcgtaagggggataaatacacaaactagcggcgtggagctggtgggtggcagcccacaggcgcgtatatttgcgaagcagaaaagaagttgggctacccgagcgtatcgtattgacgacctttctttcgcggggctccgtgagttattacgtcgaaccaaaagtcaaaagcgaccaagagacaacgaagcgagccaggtatgaacacgagggcacgactgacggcaagacgacacgaagggaaggcaacaaagcaaaggagacacacccacaagaagcgagcaaaccgccacacacggaagacaaggcccgaaacgacgagcgaaagagagcgacaaagacagaagaagaatagatacaaaaacgcggggccacaaagcagcgcacaaagcaggcgaacaacacacaacaacacgcacgaccaacaacgacgacagcacaagcagagatccaagacagacacgagaccaagagcagacagccgagagcactaaggcccggagacgaacacacacggtgaccgaacaagcac

SEQ ID NO: 64606 - DNA, 2275 bp, Homo sapiens
gtgatttatattgtactacagacatcacaattatggttgatattgtactacagacatcaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctaaccaaaaaaaaaaaaaaaaaaaaaaaaaaaaaaaaaaaaaaaaaaaaaaaaaaaaaaaaaaaaaaaaaaaggggggggggcgccaaaaaatatccccccggggggcgccccattcgcgcccaccctttttttgtgaaaaagggggcccccatggggggtcttattaaaccaggggggggcgcgctaaacaggggggggggaacaactacgcctgtggggcacttgtggggaagacgaggcaccccctacactcggggggggggccgaaacaatgggggggcaaccaccactccagaaagttatgtaagacgcgtaagggggataaatacacaaactagcggcgtggagctggtgggtggcagcccacaggcgcgtatatttgcgaagcagaaaagaagttgggctacccgagcgtatcgtattgacgacctttctttcgcggggctccgtgagttattacgtcgaaccaaaagtcaaaagcgaccaagagacaacgaagcgagccaggtatgaacacgagggcacgactgacggcaagacgacacgaagggaaggcaacaaagcaaaggagacacacccacaagaagcgagcaaaccgccacacacggaagacaaggcccgaaacgacgagcgaaagagagcgacaaagacagaagaagaatagatacaaaaacgcggggccacaaagcagcgcacaaagcaggcgaacaacacacaacaacacgcacgaccaacaacgacgacagcacaagcagagatccaagacagacacgagaccaagagcagacagccgagagcactaaggcccggagacgaacacacacggtgaccgaacaagcac

SEQ ID NO: 64607 - DNA, 1421 bp, Homo sapiens
tgttcagaggatcccccttattccttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctaaccaaaaaaaaaaaaaaaaaaaaaaaaaaaaaaaaaaaaaaaaaaaaaaaaaaaaaaaaaaaaaaaaaaaggggggggggcgccaaaaaatatccccccggggggcgccccattcgcgcccaccctttttttgtgaaaaagggggcccccatggggggtcttattaaaccaggggggggcgcgctaaacaggggggggggaacaactacgcctgtggggcacttgtggggaagacgaggcaccccctacactcggggggggggccgaaacaatgggggggcaaccaccactccagaaagttatgtaagacgcgtaagggggataaatacacaaactagcggcgtggagctggtgggtggcagcccacaggcgcgtatatttgcgaagcagaaaagaagttgggctacccgagcgtatcgtattgacgacctttctttcgcggggctccgtgagttattacgtcgaaccaaaagtcaaaagcgaccaagagacaacgaagcgagccaggtatgaacacgagggcacgactgacggcaagacgacacgaagggaaggcaacaaagcaaaggagacacacccacaagaagcgagcaaaccgccacacacggaagacaaggcccgaaacgacgagcgaaagagagcgacaaagacagaagaagaatagatacaaaaacgcggggccacaaagcagcgcacaaagcaggcgaacaacacacaacaacacgcacgaccaacaacgacgacagcacaagcagagatccaagacagacacgagaccaagagcagacagccgagagcactaaggcccggagacgaacacacacggtgaccgaacaagcac

SEQ ID NO: 64608 - DNA, 2390 bp, Homo sapiens
  misc_feature (797)..(797): n is a, c, g, or t
gctgccctccccgtcagccgccctcgccgccgcggtgcgctggctgcaggaagccgccgcgccgccgcttttgttgtcagggacccagcgaggagcgccgctcgccggccgccgccaccctctctcgctgcagcctgctgtgcgctgcacggcctggggcccgggcgcccccgcgtctgcccatgagggggccccgcgaccaccgctgcttccagcccggggcggcgcggcgctgaggcggcggcggcggcggcctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgnctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttccccaaaaccttgtgatctccctgtggttatctatataacgcacatcaccccgggattctggaccgccg

SEQ ID NO: 64609 - DNA, 1717 bp, Homo sapiens
ctctgttgcccaggctgcagtgcagtggtgtgatctcggctcactgcaacctccacctcccgggttcaagcaattctcttgcctcagcttctccagttactgggactacaggtgcataccaccatgcccggctaatttttgtatttttagtagaggcggggttttgtcatgttggccaggctgatctcaaactcctgacctcaggtgatccgcctgcctcagccttccaaagtgctgagattacaggcatgagccgctgtacccggcctgattttctatgattctgcctttaaaagacagcacgtataccaagcctttttcagaaagcttttctcttaactccttctaatgctgaattttctctctattatcctcacccaattttggctgagagttagtgtacacaatttaacttcttagaaaaattccagtgtctatgcttatattgctcacttgaatcatttgaattagaaagggatctacaaataataaaagcaaagagtgcagacagattagggatagtaattcttaaagtgccatctatcccagatttccgttatagaccagcatatgtgtaattgtgcagtgggaggtaagtagtacccaggacattgcatgtacaatactttgaaacaaagtggcaacaaagatttcctggctcaggtatgcaccccagctgctggtttagatgaagtgctgagaatatttagaaaaagcgctttaaaaagcatctagagattatcatgaaaataattggagacaaagtcactaggctgctttgtgagaggcagcataccatggctctaaacccgttcacaaaaaaacaatgttagagacattaggaattcaggttttgaaaatctttttttcgatttatttgtaatttacataccaaaaaaccacattaaaatagtcctcccttcaacatggctatcttttttcaagttttatatgcatagctctctcagcacttgaatggaaaaactgttacagcatttgggagttgtttttcttttagacatttgcagatcttatctcaaggtgactaggaacccagagctaagtatctgtgaggcaatctctgcgaacgctgaacttacctagttggtttctatgaaatatgtagaatgcactgcagtagccattgtaagaaggtactataccggttttttggggcttgttgttgttgtttggtctgagaatgtactgccaacccctcttttataagagagaactgattttgatacatattttaaaatatgatagtacagagttaatggatgttaaaattttatttctttgttttggtaagtagattaaatcgagaatcatataatcagtacatttgagaattatataaccagtatataataatactggacacaaccatttgccatcttttcctgttatcatcccatagagtgggtggggagaatgaatagacataaacctagaataatgataaatggtttttaaaactctatattgaatacattccagctgataatgacttttctttttcaccttggtgatatcagcctcagggtaaaaaaaaaagtttcataaatcttttagttataaacaggaaagttttatattagtgtgtcatttcatttctagactgttgatggtgatgatgataaagaatttggagccaattttgatatatgaatgtattgcttttacatgtgatgattaaagctctccattagcagtt

SEQ ID NO: 64610 - DNA, 644 bp, Homo sapiens
tccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttgtgctcggagagcatcactctaggtgccgtctttgaagaaggactctctaggtcctgctgttgttttaggggatcattccagcggaagtctggccctaccaaaagctgggagagggaatgagagcctcgagggcaagaggtgaggcgggagcagcatttttggcaggaggctagaagacaagaagctcattggatttatctttgcagatgccgtctgtttattacaaatgaatctggcttgccgcctaaca

SEQ ID NO: 64611 - DNA, 967 bp, Homo sapiens
tccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcaggttggtgactgagagtctggcagcgggtatcagggcagcctgcagaccacccaggcatcactgtgtctgaaatgccatgggcagctattttgtggtcttgagcagtcatggagcccttgaccccatggtcccccgtcttcccacttctgtcacacactctttgcctttattcaggttggaatatgttaggtaggagacagattctaggctttaatgatttgccactcactagcctcatgactctggagaggttgtgtgacgtcactgtgcctttggtatataagttaggctgagttaatgaccttctctgaaaaataaactccaaaatcatgtgactcaacagaaaaaaa

SEQ ID NO: 64612 - DNA, 1537 bp, Homo sapiens
tccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttgtgctcggagagcatcactctaggtgccgtctttgaagaaggactctctaggtcctgctgttgttttaggggatcattccagcggaagtctggccctaccaaaagctgggagagggaatgagagcctcgagggcaagaggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcagcttccttctcacttctgtggaagagttatcatcctggccatggctaatttctccagcagaatctagattacactttctgccttctcaggtgtattagccatctactattaatatgtaacaatattaccacaaaccctgcagctgaaaacatcacttatttattatctcccacctatggattgggagtccaggcacagcttagctgggtcctctcaggcgtgtcataggcagctcatagctcatcatcaccatcagctcacttcttcaaatcaagccactgtgtgagactccagcaagacggatgttccagtcttataaaattacatatattttatcatgtacattccatcatctttgccatattctatactttagaagcaaatcgaggtcctgccaacattttaacaggggaactacaaaagggtgtgaacactatgacttggggatcatgagaagccatacgtgaatctctcagctgcatcagggaacatgcttcttcacttacttcctacctcttctatattttcatcccctctctactcaacattaaaaaaaaatgatgatgtttctgatacctgggggagacttttttttttttagtgctcttacgtctccagcagcatctacatattgttgactctatttcacctgaacagccaagcttgttggagaagtcttctcattctttgaagagacatctacacaagactttcctttatttattttttcccttatttttgtactgaggtgcaatttatacataataagtgtacaaatcataa

SEQ ID NO: 64613 - DNA, 1105 bp, Homo sapiens
tccggcgtccagtcttcgtccgccgttaggttgcggctgctgtggttgccaacgctacactgggtagaacgccagacaggggccacttttcgagaccgagtagagacggacagtgaggaggataggacccacttacacgcttttatgtcagccgcgatcccacccccacaagcgtctgcaaaacccttcctggggccttggcgacagccctgtgtcctcacggcgcgcagaggcggcgccgcgaaccttgtgtgcattttacacgacggcggggactgaggtccctcgcagcccagagccggagcccggggtcggccgagcccgcaggaccggcttcctcgccgactctcacggcctcacccagccccctgggcccatggcggcgccggcgttgtgctcggagagcatcactctaggtgccgtctttgaagaaggactctctaggtcctgctgttgttttaggggatcattccagcggaagtctggccctaccaaaagctgggagagggaatgagagcctcgagggcaagaggcattagtatcatttgaagacgtggttgtgaccttcactggagaggaatgggggcacctggacctggcccagaggaccctgtaccaggaggtgatgctggagacctgcaggctcctggtctcactggggcatcctgttcccaaaccagagctgatctatctactggaacatggacaggaactgtggacagtgaagagaggcctctcccaaagcacctgcgcaggttggtgactgagagtctggcagcgggtatcagggcagcctgcagaccacccaggcatcactgtgtctgaaatgccatgggcagctattttgtggtcttgagcagtcatggagcccttgaccccatggtcccccgtcttcccacttctgtcacacactctttgcctttattcaggttggaatatgttaggtaggagacagattctaggctttaatgatttgccactcactagcctcatgactctggagaggttgtgtgacgtcactgtgcctttggtatataagttaggctgagttaatgaccttctctgaaaaataaactccaaaatcatgtgactcaacagaaaaaaa

SEQ ID NO: 64614 - DNA, 343 bp, Homo sapiens
tgtgtgtaaccctttgaggtacaacatcattatgaacagcagcaccttcatttgggtgataattgtgtcatgggttttggggtttctttctgaaatctggccagtttatgccacttttcagcttactttctgcaaatcaagtgtgttagatcatttttattgtgaccgaggacaattgctcaaggtatcctgtgaggacactcttttcagagagtttattctttttctaatggctgttttcattatcattggttctttgatccctacgattgtctcctacacctacatcatctccaccaacctcaagattccgtcagcctctggctggaggaaatccttttcc

SEQ ID NO: 64615 - DNA, 826 bp, Homo sapiens
aaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctgga

SEQ ID NO: 64616 - DNA, 770 bp, Homo sapiens
aaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaagggtgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctgga

SEQ ID NO: 64617 - DNA, 775 bp, Homo sapiens
aaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctgga

SEQ ID NO: 64618 - DNA, 111 bp, Homo sapiens
ctcgcctcgggatattcagaagtgctagtccagttctggcagcctgaactcttcctcctccaaggtgaaatccgagaatactcttccttccagggagagcgactgacctgc

SEQ ID NO: 64619 - DNA, 385 bp, Homo sapiens
tggaaatggagtctcactgtgtcgcccaggatggagtgcagtggcgcgatctccgctcactgcaacctccacctcctgggttcaagcgattcttctgcctcagcttcccaagtagctgggattacaggtgtcctccaacacaccctgctaatttttgtgtttttagtagagacagggttttaccatgttggccaggctggtctcgaatgcctgacctccggtgatccacccgccttggcctcccaaagtgttgagattacaggcctgagccatcgcacccagcctcaggtcaggttttgaagccaaatgagatgtgaaaaaaaattttggttttcagaggtttttggattttggaattgcacataagggactgtggatgtgcgta

SEQ ID NO: 64620 - DNA, 442 bp, Homo sapiens
acattttctattaaacattggagtcatcctgatagacatctttgtaacttcctgtcaaaacaacatgtgggacaggcgtggtggctcatgtgtgtaattccagcactttgggaggccaaagtggaagaactgcttgagcccgggaatttgagagcagtctgggccacaaagtgagaacccagctctacaaaaaataaaataattagccggagtggtggctcacacctgtagtcccagctacttggaagactgaggcaggaagattgcttgagcccaggaaatcagggccacagtgagttatgatcacaccactgcactccagcctgggcagctgagtgagaccctgtctcaaaaacaaacaaaaaaacccaacgtattatgaattatttttccatagcagtaaatgtactatatttctattaaattattgtctttaaacaaa

SEQ ID NO: 64621 - DNA, 1387 bp, Homo sapiens
ggatccagaagggtcattcaatcagttctcagtcttatcaggtctaagttcctttcttatcaggtcctaaaggcctaatcttatcattgtgacaaagataactgtagagtctgttaaacttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaa

SEQ ID NO: 64622 - DNA, 425 bp, Homo sapiens
atgatgatgaactccctgagcttttgtcagagaaagtatcactccttcatttttgtagaccaacttttctggaaactgctcattcaatgactaatcgatttaatgccatgttgaaagtatttgaaaaccaggcaaatatgttggagaggaggaaaaaaaagcctatttaatgaactcagaaaaaatgaagacaaaagaaacataaaatgaacatatggccttttccatgatacatgctgttattttacctgtcttctattactcatgtgttattcatctttcttccagatttgcatatttctccatttatacatagggaattgggaacttttagaagtttttccctgtctctgatggattggacaatgtttgcaattctaggagacatctgattattctttcaaaataaatttatcagaaggagt

SEQ ID NO: 64623 - DNA, 4442 bp, Homo sapiens
gcgacgccggcggcgccaaggcgtcgtggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatatttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagctcagagaagaaacgatctagccctgctatttcagatctttcacagatccttaagtctcaagatgaatcagcatttttagagagttcaaatgaagtttcagttgctgaaaaccaatcctataaatctccatcagagacccatgataaatcacttacaacagtatcatccagcaaagaagttcaagattcactgtctgttggaacattggctcaaaaaaacgaaacagtgatatcaccattcattttacctcctgttcttacagaaagtaaaaaggctgatgtttcagaagaacaattacaaaagatgactgaagaacaaacttaccaagcagcagaaaaatctcaagctcataatgaagtaccaaatgaaaggcttgtagttgagcatcaagaatcattgtcaaaaaccaaattacaagtaaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcctgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaagtgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaaccaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatgcagagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacaattggaaaacctacctataaagtgttacatgctgctgcccgaaaatctgtaccacacccatacttttgagaatgaaggaaattctgagcaagataagcaacatgacaaattcagaaatgcaggaaaggaaatcgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctg

SEQ ID NO: 64624 - DNA, 4208 bp, Homo sapiens
gcgacgccggcggcgccaaggcgtcgtggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatatttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagctcagagaagaaacgatctagccctgctatttcagatctttcacagatccttaagtctcaagatgaatcagcatttttagagagttcaaatgaagtttcagttgctgaaaaccaatcctataaatctccatcagagacccatgataaatcacttacaacagtatcatccagcaaagaagttcaagattcactgtctgttggaacattggctcaaaaaaacgaaacagtgatatcaccattcattttacctcctgttcttacagaaagtaaaaaggctgatgtttcagaagaacaattacaaaagatgactgaagaacaaacttaccaagcagcagaaaaatctcaagctcataatgaagtaccaaatgaaaggcttgtagttgagcatcaagaatcattgtcaaaaaccaaattacaagtaaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcctgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaagtgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaaccaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatgcagagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacaattggaaaacctacctataaagtgttacatgctgctgcccgaaaatctgtaccacacccatacttttgagaatgaaggaaattctgagcaagataagcaacatgacaaattcagaaatgcaggaaaggaaatcgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctg

SEQ ID NO: 64625 - DNA, 1931 bp, Homo sapiens
gcgacgccggcggcgccaaggcgtcgtggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatatttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaacagacatcgtggtcttcagcatctcatccacagcaccaatggaattctcaaacgctgacaaatactcgtgaatttctactggatagtcttcattaatttcttcacctgccgttatggctgactcacggccttcgactccagcctcccggaaagcggtcgggcaacgatgacgacaatgacgcgccagctctgcccgcgccaccagcggcgctttccgatgatctcaccaatgtatagctttttatacacaaattacataccaataaagtgatttaaaagtataggataaaatatagaaactaggattttattaaattattatgcataaatttatatagtagcaggataggacaatcatgttggtctttgggggagctaatagacatattcttcaggatcttgtcagtgcattgtctagctgttcacctgtgcatattgagaaataaataaataggcatag

SEQ ID NO: 64626 - DNA, 2071 bp, Homo sapiens
gcgacgccggcggcgccaaggcgtcgtggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatatttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctctttacaacattta

SEQ ID NO: 64627 - DNA, 960 bp, Homo sapiens
gcgacgccggcggcgccaaggcgtcgtggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatgggtttgtttccacctttggaaggaaacctatgtggacattggcgattcagaatggcggaagaaccctttggtaagcatgaacct

SEQ ID NO: 64628 - DNA, 3445 bp, Homo sapiens
ttcaagaagaacaaaatattttggaatctctttttaagtggtttcagtggcaggtcaatcagatggaagaaataagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagctcagagaagaaacgatctagccctgctatttcagatctttcacagatccttaagtctcaagatgaatcagcatttttagagagttcaaatgaagtttcagttgctgaaaaccaatcctataaatctccatcagagacccatgataaatcacttacaacagtatcatccagcaaagaagttcaagattcactgtctgttggaacattggctcaaaaaaacgaaacagtgatatcaccattcattttacctcctgttcttacagaaagtaaaaaggctgatgtttcagaagaacaattacaaaagatgactgaagaacaaacttaccaagcagcagaaaaatctcaagctcataatgaagtaccaaatgaaaggcttgtagttgagcatcaagaatcattgtcaaaaaccaaattacaagtaaagaaacaagaaacttctacagagcaaccactcaccactcctgataaagaaccaaatgaaaatcttatacttaggcatcaagactcaatgtcaaaatcagaaatgcaagtgaaggaacaaagaactctcaaagggcaaagaattattactcatgatgaagaaccaggcaaaaatcttgtgcctgaacatcaagattcagtgtcaaaactggaaatgcaaattgaaaaaaccaaaaaacttcctagagagaaaagacatagtactcatgatgaagaatcaggtgaaaatcctatgcttaaacatcaagattcagtgtcaaaaatccaagtgcaattagagattcaagaaacttctgaaggagaaggacgtagcataccagataaaaattctatgtttgttcatcaagattcagtgtcaaaactccaaatgcaagaaaagaaaaaaataactcctggaagggaaaggcgtaatactcgtattgtagtaccaaatgaaagtgtgatttctgttcatcaagattcaaagtcaaaactccaaatgcaagaaaagaaacaaataaattctggagtggaaagacacaagacgtttcctttagaaatcaaaaaaaaggatatatcacttgaacatctgttgcctgaggagaaagttttattatcaagaagcgaatctcaaaccaagaaacttcaagctaaagtaacttcaagaaaaaagactgatatagaaagcttgagaggtgctttgggaagacgcttattaaatgatgaattcaagacacagtcaaagagtttccctgggcctgatatagaacaattgacagatgcatttggaagagatatactaaaggatgaattcaagacacgatcaaagagtctccctgagactgatgaacgattgcatagtacaactgagagaggtacaataaatgatgcaattaagacgcagttaaagagaaagagttaccctgagactgtcttaaaacacttgaaaggtgttaatggaaaagatataataaagcatctaatcaacatacagtcaaagagtcatgcagagactgataagaacttctttgcctatgctactggaagaggtctaatgaaggagtcaaccacgacacaattaaaaagtcacccagagactgataaggaattcttggcagatgctattggaagaggtataataatagggccaatcactacacaactgaagagtcaccgagagactgataaagaactcttaaaagatgctattggaagagatataataaagggaccaatcagtgcacaattaaagagtcaccaggagactgatgtagaacccttgacaaatgccattggttcaagtaaaacaattggtgagataaagacacaactaaggactcactatgatgtgaacttatttaaaaacaaagatatgtccgtacaacgtcaagaaggtatctttactaggagcattacaccaagtaaattcccaacaaaagtgatcaatttatcaccctttgaaaataaagaggaaacttatgagtactcttcaccctatgtgactgcaccttcaaaagcaatttatagaacatatagggctggtccaagcttttctaaagacatccaccttcctttactgaatcaactcccttcagggcattcgaaagttgttaccttaagccaaaaaactattgaatttactctgcctactgtgaccaatacaattggaaaacctacctataaagtgttacatgctgctgcccgaaaatctgtaccacacccatacttttgagaatgaaggaaattctgagcaagataagcaacatgacaaattcagaaatgcaggaaaggaaatcgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctg

SEQ ID NO: 64629 - DNA, 2036 bp, Homo sapiens
gcgacgccggcggcgccaaggcgtcgtggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatatttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatgctaatagagtttctgaaatactttggaaaagtctcccaaaccttcagagagtggatgggagcgaagtaaggagaccccacctgagcagatacatggtattgcttacaataaagtacatttttgctctttacaacattta

SEQ ID NO: 64630 - DNA, 1752 bp, Homo sapiens
gcgacgccggcggcgccaaggcgtcgtggcgtcgggcgcctgggacgtggcttcaacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcaggtacacagggcggggagcctcgggagcggctcccttagcaggacctgagggtttcgggagagtcctggctttgcacttagttttcccgctgcctggctgcctccgtggcggttgtgctgctttttatgcaggatgtaggatcgaaggcaaatcatcctttccctacgtcccctgccaacccctgccgctctcctctattttgtacactttatcattaaaggatttgaaatgaatggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatatttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacaaactgctcattcaatgactaatcgatttaatgccatgttgaaagtatttgaaaaccaggcaaatatgttggagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacaggtaacacacccactctctctatgcatcaatatttgattaatacttgctctgatagtcatatatagagaaacattattacgtatgtgattatagggtatatatgtctgtgtgtgtgtatgtgtctctgtgtgtgtgtgtactaa

SEQ ID NO: 64631 - DNA, 242 bp, Homo sapiens
ggttgcagtgagctgagattgtgccactgcgctccagcctgagcaacagagcaagactccgtctcaaaaaacagaaattctttttgtaatattgtttcctgtctgctgtcatgtgctgagttgttctaagccagtgttggctgtttccttgttctgtctttccctttgttcttacatcatgtatgtctcatgtacttggttatcttggtggtgggatcatcttctgtggtcagaagatgcaa

SEQ ID NO: 64632 - DNA, 338 bp, Homo sapiens
cctagtaatccatcatccccaaagactttggtatatgttttctacagatcagaacatttcctacataaccacagtataacaagtagaaagttaataaagcaggagctgtggggacttagaagaggaaaaaaaccaaaaatacaattaagtagatttggcagaatttgatgactgcttagatggtggggggaagggcagaaaaaccataacattgtatgtttgtgtgtgtgaattgggaaatgaccaacattaaaaatgttcagttacttaacacctctgttgatattctgtgggaatatggttttaaaatgctgtattctagtagcagaggaaatatt

SEQ ID NO: 64633 - DNA, 749 bp, Homo sapiens
  misc_feature (433)..(433): n is a, c, g, or t
  misc_feature (447)..(447): n is a, c, g, or t
  misc_feature (449)..(449): n is a, c, g, or t
  misc_feature (504)..(504): n is a, c, g, or t
  misc_feature (509)..(509): n is a, c, g, or t
  misc_feature (520)..(520): n is a, c, g, or t
  misc_feature (534)..(534): n is a, c, g, or t
  misc_feature (540)..(540): n is a, c, g, or t
  misc_feature (546)..(547): n is a, c, g, or t
  misc_feature (549)..(549): n is a, c, g, or t
  misc_feature (554)..(554): n is a, c, g, or t
  misc_feature (556)..(556): n is a, c, g, or t
  misc_feature (559)..(559): n is a, c, g, or t
  misc_feature (564)..(564): n is a, c, g, or t
  misc_feature (568)..(568): n is a, c, g, or t
  misc_feature (573)..(573): n is a, c, g, or t
  misc_feature (576)..(576): n is a, c, g, or t
  misc_feature (579)..(580): n is a, c, g, or t
  misc_feature (583)..(583): n is a, c, g, or t
  misc_feature (588)..(588): n is a, c, g, or t
  misc_feature (590)..(590): n is a, c, g, or t
  misc_feature (596)..(596): n is a, c, g, or t
tagctatttattcagatcggacatttccccctgggcaaaactaaaatgtatccctgctggatggcctcactgagtttcttgtcttaagattttttttttttctgtgaactctgcggagaagtatctttcggatttttggctcagtaatccttcactgtcatattagttctttgatgcctatatgaagtttttgtttttattaatccaacattttaataaatcattataaattttctgagattgggcatgttgtatgttttgttcacttctattctagaagagtactggtatatagcatgcatccagtagttaccgaatgattgagttttgtttgtttttgttgttttttgtttttttgagtctgaatcttgctctatcgcctaggttgtagtgagctgagatcacaccactgcacaccagcctgggcgacaanagcgaaactccgtntnaaaaaaaaaaaaactgttgcagccccgttgagcctttgacaccgcctgaaatccnccccnctcccggaggnggaggaggaaggantgccantgcctnnanacacnanaantcctntggnggccncancanntgntgganancccagnctggacctgcccttaaaagaatgagtgggaaaggggagggaggaagggcaggtaaaacgtcctccccagggccccctgcaacggggaaggtactttttacaaaagctatcattgtcaccctaaatgtggaataaaataagatgcatcgacgta

SEQ ID NO: 64634 - DNA, 208 bp, Homo sapiens
ctacaattccctactagcccatctttctacttctactctaactcagtcagctctccagacagtagctcaaataatcttgttaaaatgcatatcataccatgtcactttcctgttcaaaaccctccagtgacttccattacattaaaataaaacaagagtttcttaccatggtttgtaaagctgtatataatctaatccctagaaacaa

SEQ ID NO: 64635 - DNA, 142 bp, Homo sapiens
ttgcaactggcagagctggagggcgagtttctggtcaacgagttcatcacacgccagcgccggagggaactctcagaccgcttgaatcttagtgaccagcaggtcaagatctggtttcagaaccggagaatgaaaaagaaaa

SEQ ID NO: 64636 - DNA, 423 bp, Homo sapiens
gtgttcttaggatggattgctcttttcttagaaaatggcaacttctttccctctttctggaagaaagtcagaagagaaaatccagaaccagagagcagcccaaagggccaccgatggagacaccagcaggaccagcaaggacccaccttgggtacggacccaggcacaggggccagggagccactgtcggcctcaagcagggaaacgctaactgtggaatgaacgagttccacataaggaggcaggaatcttctcctgtaaagctttttcttcatttctttttctttgatattcactaagaagacttctcataccttttgggattttgattaacaacaaacataagtaagtgttatggttttcttctcgtagacgctgcactccttattaaacttatagatgctgtactccttattaaactta

SEQ ID NO: 64637 - DNA, 345 bp, Homo sapiens
  misc_feature (111)..(111): n is a, c, g, or t
  misc_feature (136)..(136): n is a, c, g, or t
  misc_feature (144)..(144): n is a, c, g, or t
agtcacttgtttatttctcaagatgtgcacagcaagcgtggaataatcagccaatatataacattccatcagtattttattaaggaaataacctgaatgtggttgattttnacatagctgcaattacagttttctnctattttncaagccacaataagaggcagagacacaggtgctgtgttgttcatttatttcttgtaaatttgttgcaagcttaatcattcagggttaaagctatttgcaatattattgaaaagactaatgaggattagaaaacaaagctacaactacacctttcgccataattattatttactatttccctttcccatcactcattttaga

SEQ ID NO: 64638 - DNA, 288 bp, Homo sapiens
ggtttccaaaggtatatgctttcactaaggaatgcagcaggaatctcactaaattataagtcatgattactgcttgtgaatttgggggatctttgcggcaaggggacaacagacaacaagaggaatcaccatcctagaatagcagctgaccctgaagatcagaagctagggctgtcaagacacaatgatgaatatgtctgacaagcaggagacccacttgaatgcttctcggtgttcccttgtccagttttgttggtaagtggacagaccagcagccccaagctgaga

SEQ ID NO: 64639 - DNA, 275 bp, Homo sapiens
aagacattaaacacagactgggtattagattaagaaagtgttttgctgggtgcagtaatgacattgtggttatattaaaaagagcatgtgtatgtatgtggtaaaattatatactcggtagttaagcatggtggtgtgcacctgtggtgccagctgcttggaaggttgaggtgtgaagatggtttgaggccagcattctgaggctgcagtgtactgtgttcacacctatgaatgcacaccacctggacaacatagacccatctctaaacaaaagt

SEQ ID NO: 64640 - DNA, 912 bp, Homo sapiens
atttgtcattttatgaaaatgttttactgatagttaagaatttttattctagtggttatctttgtatttatactttattctccattttcttatttaagatttactatctagtttgtcaggttttaatgcctgtaattcacacttattgcctatacagcgatcaatgattttaatctcacgtctttttgctcccattttttagttgttttatttctacctgattgcaacatataatgtttgtgtattggttttgcactcgaattcctactgttggtttagtctgaaagctactattaaatatagtaaatattgtaattttattttgctgaagtttttcagtcatctcttgttgaatgaagctcattcattagtagatcttcatgagtggctcaggggtacataattgtctaagttatgtgtttgaagctgtttttctattatagtgttttatactgaaggacagcttgactgaatataaaatcttggttcacactttcagttttttgaaaatttattgtcttgctttatatatattttttgagaaatctgataccagtctaattattttgcccttgtaaattatttgatcacgtatccctgaatcctcgaggattaaaaaatttttttcggcctggctcggtggctcacgcctgtaattccagcactttgggaggctgaggcgggcagatcacgaggtcaggagatcaaggccatcctggctaacatggtgaaaccccatctctactaaaaatacaaaaaattagcctggtgtggtggtgggcgcctgtagtcctggctactcgggaggctgaggcaggagaatggcgtgaacccgggaggcagagcttgcagtgagccgagagtgcgccactgcactccagcctgggcaacagagcgagactccgtctcaaa

SEQ ID NO: 64641 - DNA, 771 bp, Homo sapiens
agtaagggcttaatcatactcattggcttttctgcctttgcctgtttctgcattgccacctggctgccattagagggaattcattacaactctgagtccctgcagggagctgagaggagctatccttgtgtttaggatgggacatgtgttcttaaaactgggccaggcacggtggctcccagcactttgggaggccgaagcaggtggatcacttgaggccaggagttcgagaccagcctggccaacatggtgaaactccgtttctattaaacatacaaaaattagctgggtgtggtggtgtatgcctgtaatcccagctactcaggagactgaggcacaagaattgcttgaacctgggaagtggagattgcagtgagccgatatctcaccactgcactccagcctgggcgacacagcaagactctgtctcaaaaaaagaaaaaaacaaaaaacttaaaaatggttacccagatttccttttatgacttgttcagtcagaggcagctgggaggatgcacgctggggaaagcattactcaccaggcacacatagtggccctgactgctggcaagtagtctgggctgtgttaagagtgagtcacctcggggaatggaaaaattgcaaggtactgaggggtaggagttgtgtgccagtgactgctccttttctgtctgctattttctctataaggactcatcacaaaaccataaatactgacgatcctgttgaggcagccgtgaagccaaccaactttatggtgataatgtttcc

SEQ ID NO: 64642 - DNA, 411 bp, Homo sapiens
tgtttttaatttggtaatgatatctgctgatttattaagtgaaaaaagtaatggtgtcattaccttggatgaagaaacaaaaataaagcatttgccacatttttcaactttgttttcctttcttacaaaattgctataagctcattgcccccaaattggacaatatagggaataaaaaagataatttggggtggggttagacacgggtcttgttatgttgccgaggctggtctctaactcctggcctcatgcaatcttcctaccttggcctcccaaagtgctgggattataggtgtgagccacttcaccaagctgagatgccacctcttaaaagagagaataaggacagattacagccactgctcatgcctgtaatgtcagtactttgggaggccaaggtgggagaattgc

SEQ ID NO: 64643 - DNA, 821 bp, Homo sapiens
cacaatctgaagggccggtctcactcccaccatgacctccacccaacagcactgagtctgtttccacgtagtgggtgagcaggtctgagaacttgccccaggctacccacctcccagctgtgaaagcaaatatggcttttttttcttctcccacctgtggagtctgcacaccagattcatgccctccctcgagttctggctaggaggcttctcagtcacttcaaattgttacaaagttcagctggagatttccttctccctgtagcctttcccaatgcctctgtctgccctcccaaaagacctctgtgaggccaggcaaaaacggcttgttaggggacccagtgagctcccagtgcttttcctgctgcttctcctaacactgtatgtttcttggctctctaaactcactcagctccagatgcctctgagtcatttaaagtcaatggccacaatttccttggcattttctcctcccttggcttccataacatttcttgaagtcatttcttttacctctgtggctttttttgttacttctttgcaagttttgccagaactgaagaggccttgcaattgtgaagagaaaaatgcagcagtgagttggaactgacgaccagagaacagttgggagggcagtcatgctggatgtcagcagggcaatgatgacaaccccaacaccttggcacaatgtagcccttctgggactatgggcacaagtgaaactgaagtaggggggaagcctgaatcaactgagattaatttttcacacctagggaaacgggaactcaaaattaaaattaaatttagttgtgaaaatacaa

SEQ ID NO: 64644 - DNA, 775 bp, Homo sapiens
acctgtaatcccagcactttgggaggccaaggcaggaagatcacttcaatccaggaattcaagaccagcctgggtaacatggcgaaaccccgtctctacagaaaatacaaaaacaaaattaaccgggcgtggtggcacatgcctgtagtcccagctgcttgggaggctgaggtggaagggtcactagagcctaggagattgagaccacaatgagccacgatcacgccactgcactccaacctgggcgacagagaaaaccctgtctcaaacaaacaacaacaacaaaggcttagagaaaaaagtcagaagtgggaatcagtgaacagtggagtaagactatgtggcagtcaacaagcaatctttttgaactacctcgctagggattgttggggagaactaggagactcacaaaagagaaaaatgaaaccaaatgtatatttgtgatatatctgtctcacagagcacctcttgtgtgccaggtatttgatgtctgtcttctcctttaatctttgcaattgccctttggagtaggtagatttcctctttatagaggatgaaaaggatcacccaagctagcgagttgcagagctgggattttaatccaaaacctggactgagcacatgcattagctggtacaaactgcattatgaaaacatttctaggtgcaaaatggcaggagtgaagatggagcacctctagacataatatgggatgaaccaaaatctagtttgaaaatgacttccagaacctttgacaggtttgcaaccttcttat

SEQ ID NO: 64645 - DNA, 1687 bp, Homo sapiens
gagttaaagatgatatttttaggagaatttgggaagcgatgatgttttatttctgtaggtcagtcctgtgacggctttgcgaggagtatggcccttcagagatggatgatgccaccttactccatgtttggggtacagtccagcactccccatgaaaaattctaagttgtgagggaatctgcccatttgctggagattgagtgcagaggaattccctaaccaatcagagatatcccgtgattccaggatttcagagtcctttgtctcctctgaggtgtcaccttctttgtgatgtttcctttgactcactccttcatgttagattcctcacaccaagggtctatccctacagtagcataactcaaggaacgggactcttcccagtgggtccctagtagcatctacatcacatcaaagggcaatatatcctgcacctgctcttcccctcggagcaaagccccaagtgggataggatgttggggactgccagagcattcccattctctgagcagcatcatacctccattattttatatttgcaaatgtgttttgtagaggattacactggccaacatttatatacctttaaagaaattattttagtgactgtctgttgaggcagtgaagagctgatttgctgtgtgtcatcccattggatagctgagtgaccgctcttgcatcattgaagttgaatcatgccttagctaactgaatataatctttgtaaaataattttctactgagctgttttctagtcagctaaagccttgcttatttttcctgtttattattaacttctgcctttctctcaaattgaaacagtcaggccatacacagcaagctcccaaggataacacttgttattatttattttcaccatgagattctctgcttattttctttggaatcctagttctgttgcatcagggaagcctaagggacttgttcccctcacctctgtgtgcctcttagggtctggtcacttttgaagtcctgggcatggttacatttcattcatactggtttttcaccaactgtcagggtttctgtgttccattagcacaaaatagctaaaagaagatattttcactgtctaattcactattttcatgttacatttctgaaataattgaactttaggggcaagatactacttactgaagcacaggtaattactgagaacccacagcccagcaaattctaagagacagtcatttcctcagcccctcccagtccaaatttatagacccaaacaatgaaatgaaaactgtttgctttgatcctcaccctgttctctagagcacaaacaaatagtaacaaacaattgaaagaaagtgcttcatagtaggagagagattggaattctctatagtgactgagttcttaaatttctttagttttagttttgccactttgttgagagatgggccttttagaaaggaagacatatttaaagtattgatttcttttcccccagtgttttattgtgaaaaaatttcagcaaacagcttaaaagaaatataaatatattgtaaaccaaaaagtatctgagacaggtctcaatacatttagaggtttattttgccaaggttcagagcccatgatggggcctcaggaggttcttagaacatgtgcccgaggtagtcgggttacagttttatacatttgagggagacagaaggtccag

SEQ ID NO: 64646 - DNA, 455 bp, Homo sapiens
cagcctcttgagtagctgggactacaggtctgtgccaccaggttttaaattttttgtagagactggatctccctatgttactgctagtcccaaactcctgggctcaagcgatcctcctatcttggctttccaaagtgctgagatcacaggtgtgagccactgcacccatcaggcctgttttctgatcctatagttttaccttttagagaatgttacatcaatgtaatcacacagcatgtattttttctgaccgcttttctgcacttagcgtagtgctttccagaggcatccatgttgtagcatgtttcccgactcccttcctttctattgttgagtattattgcctgtacagatgtacctcagtttgtttacccactggccaggtgatgaatgcctgagttgtgtccagtttttggttatgaataaagcttctatgaatatttacatacaaatct

SEQ ID NO: 64647 - DNA, 346 bp, Homo sapiens
cctaaagggaagggtttgggtcattggggcactgccctcgtgactggattaatgccattatcttgggcttgttatctcaggagtgtgttccttattaaaaagatgacttcaccctcccatctctcacccatgtgatgctttctgccatgttatggtgtgacaagaaggcccttaccagatgttggtacctagatcttggacttcccatgctccagaactgtaagaaaataaatttctgttctttataaattacccagcctgtggtaatttgttatagcagcacaaaatggactaagacagagggttacatacaagagattcattgagggagggagcagaaggcagg

SEQ ID NO: 64648 - DNA, 1639 bp, Homo sapiens
tgtaaacagctttcatataattcatgatagaatattactatgtgctttggaagacactgaggaaagacaaaaggtcattgggcagaaccaccctagattgactgttaaggccatcttctagtttgcaggacttgtggtagacagacagaataatatcctggacctcttgggtgtatacaggacaaactgaaataaactctcatttttagatcataatgtcatcatgaaacatatcaattcggtctatttctgaagaaaacaagcacaatgataaagtttgaatgtttgtctcctccaaatctcatgctgacatttgatccccaatgttggaggtggggcgcactgggaggtgttttggttacgggggcagatccctcatgaatggcttggtgctgtcttcatgggattatgttctcactcctacttcctgtgagatcttattgttaaaaagaatctgataccttcctcccctctcttgctctcttcctccctgatcatgtgacacacgggttcccctttgccttccaccacgatggaggcttcctgaggccctcaacagaagcagatgctggtgccatgcttctcgtacagcctgcagaattgtgtgagccaaataaacctcttttccttatatattacccagcctcaggtatttgtttatagcaataaaaacagactgagacacatgatgaagaccctttgatatcctataaatattgatttctctccctgagagaagagcatgaatctaagtgatgccattactgtaatgtgaattccacaacttttctcaaagatgtggcccatatgtttctaataatggctttctaagaatctgttctgaaggggtaccttctctctgattttcatttgcatttcctgcttagcttacacacttcaacttgcctatccacctgtcctgaccccaataacctccatcatcagacatctcatcttacctacctactttctacttttcccagtccttcccgtgcttcataaaccatgatcatgagctagagacacaaggtcatagctaaggagttgggatcagaaaatcaccttctgtgattttccattattctcaatacgtaacttcaacaaaatcaagaaaatcatgaaaggacatcctaaggggtcaggtgaggttgcagtggggttagtcggtcaatagtttctttatgccaattaggatttctgcagaaaacaatgaaacactggtttaaacagtaaaaatattttaattccttacagaagcccatggaacatacactccaggtttaattcatcagctcaatagcatcatcaacgacttaggttctttccactttctgcttgtcatctgtgttggctttattttcaagctagctcctccctggttgcaagataattgcagcaggtttagttatcatattcggacatgctaacgcccaggctagtgatcccttccttacatttctttctcattttaagaacaaagtgtttaaaaaattatacttaaaattattggcatctctgtcaattgaaagatgtcaatctctttcatttttcctaatcactaataacatctactaaaaacaaaatgtctgtgtaaataatttatttgaataaaattaaagttgttgagtgaaatcggctt

SEQ ID NO: 64649 - DNA, 361 bp, Homo sapiens
aaccagaagggcggccagggccggcggcatgccatgccaggcagccccgcgccaccccggaacactgggacactctcatattcccaaagggacttctccatgcggcgctctgaccaggcatcgccgcaggacgcataacagagagagcgagcgcagggcacccggcccatcagctcttccttcacctgaactgccccggcctcgctgagacgcggattttaaaaccgccctgcacctatgtgctggcagccaggccctgggaacttcctccaaacactcccatgagttcgggatgactagcatcagttttcagctggagagcagacggcaactgaacgctgcgaagtcccacgatggggat

SEQ ID NO: 64650 - DNA, 2546 bp, Homo sapiens
ttttttttttgcactgaagagtttctgtgaaggagccccagagttgggaatgtgccagaatcaggccaacaccagccacacctgtccacagtgccccttcctgctccagttgatccagagagctcctccctctaccctcatgatgccagggagcgtgattgtgggtgtgtctctgactgggacacccaggatagggtgtgcaatgaggccaggaccctcctaaaccctaacagcatcctaacgaggcccattgcagctttcgatttccttcgtaacagagctcgcaggccctcagttgcagagctctcaccttctggagtgactccatcgttactccagtctttctaggtggtggaacactccaccacacatgccatttagaaagacgccagcttggcctttccaaaaagttaaccagtcgtctccccaccacaaaccctgtgggagcaggttactcttaggatgcacacccgtcaacgaggccattgcatttttttgcaggcatgaacggctcccatctaggcactaacccaggagccaaacaactgctggggagagttcagggcagctctttgggcggtgcctccagctgcagctttgccttgccacctggagccagcacgcctctgcccgacccaaggaggatgccatcactagatcctatttttttttttttttaactcttgaatctgaatagttcctgccgtggggagaggtattgttcagggaaaatgtgatcgggattttagtgtggctgtaaacacagtcttcccgaaaggcttactgacgtttgaatgtgcaaatggtatgacgaaagatgtagggctctttcgttgaacttctctacggcgggcgggcggacacgtgttccaggtggacttgcctgccggccaggctttgagtctgaacttcctctaactgcagctgggctcctggcacacgcggtgccctggcatgatggtcctccctggccaggagcgagtcctaaggaaattcattccattgaccggactcctcccatgataggcccatggcttctctgctggccttagttcttggcccttcagattccctggggatataaggcccaagcggatctccctgcagccagccagcagacagcccagggtttccgcccaaagtgccctcatgttgcagtccactttgtgcatggaagatattgaacacaatttccactgctcttcctgcagggcctcctttccagcagtcacttgctcagactgaggggtgcacctcccctgccattgacaggtcctgcgccttcaggatgggctatttcaagcccgttttaagtggctcttacacaggctcagcaacctctgtggcctgcaggatgggccttctgctgtctctttcctttcttaaaaccttaaggtctttctagagacctattcaattttctttttttttttttttcactacaatgtcatgacaactgcagcaatttgtgttactttccaagatgacaatttgacattaattaagggaaaaaataaaaaggtgagctagatgacttaaaatgcatctcttttttgaaaaagctgtagctggcaagtcaaagtttattttatgtgtgtaaattcccagttgagcattttttcatttggattagcgtgagaggaaaaaatgtgaaatgtctcaaatcaaatgcttccttctaaagattagacattgcccaaccctgcccccgcccccaatcaatcagtgacagaagagaccgccatcagccaactagctttttttaaatggctgatatattcatctctaaaggccctcaaagcactgtaaaacttttaaaactttagcctttatgtcagattagagaaaccaaacaacgtgacggtacatgtgatgaaaagctctgggtttatttttctcccgcttatgaacatgtatttttatttgccgaatgaaaatcgtggtgtgttgctttgatgaatggaatttcaggctctccctgtgcacagccggtgggcaaaggtcaccttaaatgactttttctccctatctgtctgttaatccccagaccggttgcattttccagttgcttcctgggtgtctgtacatagtttgtctttgtataggagtgagtgtggtgaccgtcaatcccctaatctcccaggttctaatttaacagatgatggctgtatgaggaaaacgatgtaaatagagaatacaaattaaactggatctctgtggcctaggttttgtacatacagaaactgcatggtatttaaattattgtttgtctctgatgatgtatgcagtttctttaaaaacaaaccaaaaaaaagtaaaaaaaaaaaaaaaaaaattcttgactcttgtgtgttttgttatcaaccagcagcagaaaccaccaaaaatgctttgactgggaaagggaggttgcaggaatgggagaggtcagctcatctgcaaaatacatagtgagagtgagtggacatacgggacaaccgcatgtctcctctggtattattgggggaaggaagtattgtagcacatacattaactttctagaagac

SEQ ID NO: 64651 - DNA, 307 bp, Homo sapiens
agatctcagccaaaaggttgtgtgatctttgattttaaaaatttaagaggaacttttcctcactggaacacaatgattttattaataaagaatgtaggctgggtgcggtggctcatgcacgtaatcccaacaatttgggaggctgaggcgggcagatcacgtgaggtcaggagtttgagaccagcctggccaacatggtgaaaccctgtctctagtaaaaatacaaaaattagctgggcacggtggcgggcacctgtagttccagctgcttgggaggctgaggcacgagaatcacttgagcccagga

SEQ ID NO: 64652 - DNA, 1000 bp, Homo sapiens
atttcattcaaaagacaattaggaagatggttttctatggaaaatatttaagtgtaggtcttaatgtgaaagaaagagggagagaaagaaacccctttattatgttctcccttccttaggcattttttgtcccgtgggaaaaaactgtactagggacagagacctctgttaagttttagagaaaagggatcttttttttttttatttgagacagagtcttgctctgtcgcccaggctggagtgcagtggcacgatctcggctcactgcaactccgcctcctgggttcaagcaattctcctgcttcatcctcccgagtagctgggattacaggcgctggccaccacgcccggctaatttttgtatttttagtagagaccgggtttcaccatgttggccaggctagtctggaacccctgactttgtgatccgcccgcctcggcctcccaaagtgctgggattacaggcgtgagccaccgtttcaggccgagaaaagggatttaaaatgagaagcttgaatcttattgaacataattgtaggactgccagagaggactggtggatgaggaatatggcaagggacatgagatgggaaaaattaaataggctgtggtttggaagtctcaaagtgaaattcaaggtgcaaggctcttaaaagttaaatccagcgattcggtacatagcttaggccctattaaatgacccagtgctttaagaactatcttttgaaaggaacacttcacacaagcaccctcaaaaataattagacacctccccatttctctgttaaatggtgaaagacacccaagactagacctaactactgtcaccctctcctggcctcttggcagccaaaaggccacatggcccaggctctccagcatcactgtgtagccgacttggacaaaaatggacttctccccattgccacttgcagatctcttcaaagaatcagcagatctgatagtgtgcccctcttcatccccggcaaccactgttaaa

SEQ ID NO: 64653 - DNA, 773 bp, Homo sapiens
cggccgcttcctgcagactcgtgtttgcagcgtatctgtagacggggaggctgcagtcctcctggaagtcctgtcttggagggtgcaggagagcctcgagtttccaccagcaagtttgagggacactgagaggctccctcccttcctccggaccgagctgttgcccccatgtctctggcaggttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggaggttggaaatgtggctgtgaggtgggtgagtgacggaggacggtgggcccaccagcttctcccatcacacgtggtggccatggaactggacagatggggcagtggaggccagaacaaggacagaggacagacccagatgggttttttaaaattgtgatcaaaaatgcattaacgtgaaattcaccatcttgaccctgttgaagtgaacggtacaggagtgttaactctgcgtacgttgctacgtgacagatccctagaactgtgtcatcttgtaggactggactctccccattgcacattagccccccatcct

SEQ ID NO: 64654 - DNA, 3320 bp, Homo sapiens
ctttactctgcatctgtgagtttggatactttagatgccccatatgagggaatcccatacggtatttcagaactgagatgtttcagcccacaaaagaatctggccttgggggaggacttgtcccctggctacggacaggaccacgatgtgggagcatttggcacccaggccccctgttcctggagggaggggctggtggacgcgatttggagctggcttcgatttctcagtggtctctccacggcacccatcacaggacctttttccccaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagaacttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64655 - DNA, 3362 bp, Homo sapiens
  misc_feature (2774)..(2774): n is a, c, g, or t
  misc_feature (2788)..(2788): n is a, c, g, or t
  misc_feature (2815)..(2815): n is a, c, g, or t
ctttactctgcatctgtgagtttggatactttagatgccccatatgagggaatcccatacggtatttcagaactgagatgtttcagcccacaaaagaatctggccttgggggaggacttgtcccctggctacggacaggaccacgatgtgggagcatttggcacccaggccccctgttcctggagggaggggctggtggacgcgatttggagctggcttcgatttctcagtggtctctccacggcacccatcacaggacctttttccccaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagaacttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccgggnactgtcctgggtgnagggcaggtgaacaaagctgctgcggngactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64656 - DNA, 3468 bp, Homo sapiens
ctttactctgcatctgtgagtttggatactttagatgccccatatgagggaatcccatacggtatttcagaactgagatgtttcagcccacaaaagaatctggccttgggggaggacttgtcccctggctacggacaggaccacgatgtgggagcatttggcacccaggccccctgttcctggagggaggggctggtggacgcgatttggagctggcttcgatttctcagtggtctctccacggcacccatcacaggacctttttccccaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagaacttcacctgtcggcttggagagatccaggtgatgcttcccagaggggctcgggctgggctggctgtttgtccagctggagtgggggtggaggagtcagggaggggaaatgtgtgcgtgggggcaccctctccccgcccccgggcgtccagccgtgctgagccttctctcctgccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64657 - DNA, 3518 bp, Homo sapiens
ctttactctgcatctgtgagtttggatactttagatgccccatatgagggaatcccatacggtatttcagaactgagatgtttcagcccacaaaagaatctggccttgggggaggacttgtcccctggctacggacaggaccacgatgtgggagcatttggcacccaggccccctgttcctggagggaggggctggtggacgcgatttggagctggcttcgatttctcagtggtctctccacggcacccatcacaggacctttttccccaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagaacttcacctgtcggcttggagagatccaggtgatgcttcccagaggggctcgggctgggctggctgtttgtccagctggagtgggggtggaggccgccccaggccgcccccttcttgggttcagcggggaactggggtggaggagtcagggaggggaaatgtgtgcgtgggggcaccctctccccgcccccgggcgtccagccgtgctgagccttctctcctgccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64658 - DNA, 2932 bp, Homo sapiens
tatagttagtgaagaagccgtcgcaggaatcaaagaagaccctgttgtgctgattgagttcgtcttgccatttgagctgcccactttgcaccacgctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64659 - DNA, 753 bp, Homo sapiens
tttatcttttgttgtgaattcctcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64660 - DNA, 1742 bp, Homo sapiens
acagtgtcatggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcacggaggcagctccctgctcgtccggggtgtgatcccaccggaggttggaaatgtggctgtgaggtgggtgagtgacggaggacggtgggcccaccagcttctcccatcacacgtggtggccatggaactggacagatggggcagtggaggccagaacaaggacagaggacagacccagatgggttttttaaaattgtgatcaaaaatgcattaacgtgaaattcaccatcttgaccctgttgaagtgaacggtacaggagtgttaactctgcgtacgttgctacgtgacagatccctagaactgtgtcatcttgtaggactggactctccccattgcacattagccccccatcct

SEQ ID NO: 64661 - DNA, 460 bp, Homo sapiens
cggccgcggcggcggcggccgggaaggaggtggggctgcggggcccgcgtgaaccccgatccgcggggctgagagtccgtggccccggggcccgaggtttcccggcacgggcgcgccgaggggcggggggccggcgcctgtgtccgctccgtgcacagtaagggacagagggtggcagcgcccctccgccccggtccgccccgccgtcctcgcgccactgccgggcagcggcctccggcccccgtgcgtgacccctgcctatctcagaaatacgggtgcaaacccgagtggccgcggggcccagcgggaatcccgacgccccggccagacccctgcttcccacgtcgctggtctatgcggaagatcccggcggcggtgctcatgcctggctcagtggatgccggctggtggaaggggtggccttctgtaggggtgacactagaactgagtctttggggag

SEQ ID NO: 64662 - DNA, 150 bp, Homo sapiens
ccatccctctgagtactaggaggggaaaggctgagactgcagggttggtgggggtggccccatccttctgggcctgggcctcacagcaggtccttgttgcttctcagggtcttctttgattcctgcgacggcttcttcactaactataac

SEQ ID NO: 64663 - DNA, 221 bp, Homo sapiens
cctgtctggactctggtcctgatgtgcccagcgtctccctctgtctcttcagtcgttggagctgatccgaaagcatggcttctccgtggctttgtttgcccccggctgggtgtatgagtgtctggagaagaaggatttcttccagaaccaggacaagtgagtcctgctgtcctgggtgcttagtgcaggctgatgggagggaggggtttctggtgtctctg

SEQ ID NO: 64664 - DNA, 2738 bp, Homo sapiens
acagtgtcatggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaagtcgttggagctgatccgaaagcatggcttctccgtggctttgtttgcccccggctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64665 - DNA, 861 bp, Homo sapiens
cttcaaacagtcaaagttcttgtgaatggcggtggtcattgatggtggtgctcattgtcgatgtgtcttggcttactttacacaaaacaaactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttctggcaaggcaggacacaccagcacagaggaaggagcggggccaggccggtgcccctggcgtgggatgcgcagggctctgcctgcctctggtctatcagtcctgcccgttcccagagccccagggatgttctcagcccttaatttagctttaaatgagtaaattaatccaataactaaagagcctctttactgcccgtgat

SEQ ID NO: 64666 - DNA, 3936 bp, Homo sapiens
acagtgtcatggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64667 - DNA, 2619 bp, Homo sapiens
  misc_feature (2031)..(2031): n is a, c, g, or t
  misc_feature (2045)..(2045): n is a, c, g, or t
  misc_feature (2072)..(2072): n is a, c, g, or t
ctttactctgcatctgtgagtttggatactttagatgccccatatgagggaatcccatacggtatttcagaactgagatgtttcagcccacaaaagaatctggccttgggggaggacttgtcccctggctacggacaggaccacgatgtgggagcatttggcacccaggccccctgttcctggagggaggggctggtggacgcgatttggagctggcttcgatttctcagtggtctctccacggcacccatcacaggacctttttccccaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagaacttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcagcctcgtccaagcaccgggaagacctccaggctgaccccttgagcagcagtcagcacagaaggagaagtgagtttgccaaggatatggggcaggaggctccctctgctgaccccctgcagcctggagccagcccgggnactgtcctgggtgnagggcaggtgaacaaagctgctgcggngactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64668 - DNA, 3020 bp, Homo sapiens
gaccgcgcagccacagccagttggggcccagcccctgcccccctgcccttgcagcagcgctgaccgcctctcccgcgccctcttctggcgggcttgtggaacgacgggggtgatgcccagcagcctccagtcgttggagctgatccgaaagcatggcttctccgtggctttgtttgcccccggctgggtgtatgagtgtctggagaagaaggatttcttccagaaccaggacaagttctggggccgactggagcgttatctgcccacacatagcatctgctccttgcctttcgtcacgtccttctgcctgggcatgggtgcacggagggtctgctatggccaggaagaggcggtagggccctggtaccacctgagcgcccaggagatccagcccttgtttggagaacacaggctgggaggggatggccggggctgggtgaggacgcactgctgcctggaggatgcctggcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcaggtgaacacaagctgctgccggggactgtcctgggtggacggcaggtgaacacaagcggctgccgcatgtagccactcactcgactttttttcagctgtgaccattcctgggagctctttgagcctttctgtctcatttggaaccagggggaaccaggaaggggctcctggcctctctgtgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64669 - DNA, 3176 bp, Homo sapiens
ctttactctgcatctgtgagtttggatactttagatgccccatatgagggaatcccatacggtatttcagaactgagatgtttcagcccacaaaagaatctggccttgggggaggacttgtcccctggctacggacaggaccacgatgtgggagcatttggcacccaggccccctgttcctggagggaggggctggtggacgcgatttggagctggcttcgatttctcagtggtctctccacggcacccatcacaggacctttttccccaggttattttccctgcaggccccagtgccacccaagatttacctgtccatggtgtataagcttgaggggcccacggacgtcacagttgctttggagctgaccacaggggatgccggcagctgccacatcggtggcatctcagtgttgaacgcagaaacaagctcaagacacagcctccgacccctccgggtgccccccaccaagctggccagatgggtgggccgctgcggccggcagctgagtgggggctgggtccagcactgctacgaggtgagcctgcgtgggtgcctgctgctagacctcctcgtttgcttctcacggccgccgggtagtcgggaggaggagaacttcacctgtcggcttggagagatccaggtggtggacgctgccagcctgctggcccctctgccccaggtgcaggccgtcaccatctctcacatccgctggcagccatccgcctctgagcgggaggggccccctgctctgctccagctcagctgcaccctgcactggtccttcctcctctcacaagtccgttgcttccgaatccactgctggggagggatgagtgatgactctccgggcagggagctgccgaggccagagatgcccatgttcctggggttggcttttgccaccagtaccggatagtggacctgctggtggaagccgccgggcccggccaggatcgtcgcatggaatttctggtggagcctgtccccaaggaagggttccgggtacctcaggccgagtggggcagggcagttctgctttattcagcccctgcatgagcggatgctaaggccgggtggtctcctggcctcgggctgaggcctcttcccggctgtctgcccctggcctgcgctggacctgctaagtgcccacagtggcagcgaggtcccggtcccggggctggggtgggagaccccgggctgagtgctgtggctttctggtggggggcgatggaaacaggaaaccaagcagtgggatcgcagcgttggtcactgcgaggcgagtggcgggctttctgtttctgccttgtccctccccacggtacctggttcccaggtgaaaatgaaaggaggggagaagttgagaacagaacattccataaaggatatttcctaataggctgcaagatgctgatgccgagaatgatgattttctttcctgcagatgaaactattagaaagggtcttagattgtggcaggtaggctttggagcaggcgccgagacatttctgagcatgaggacgagctacagcagctcctggggtggggctgcctgcgggatggcgggagaggatgccctggagaaccgtcctcccagtgtggaaggcccttttccctgaggagtgggcattctgggccagccggcgctggcttcgtgcctccacgtgggccagccccagctgctccgtgtttcctggcgttggcaatttactgtgctgctgagtgtgaggtcatctccggagcgttttcagcagcccctggctctgcggcgtctcttccgggctgtgggcatgcagggaagtggctctgaggcagtctgcgctgtggccctgcctctgcccagcgagaggccgtgggctctggacaagccgcccttcaggctggggtagcaggtcagtccaggcaggaagcagcacctgccccccgcgccagcccagccccagcctgagtgcaggagctgcaggacccgcgggggcttttccagctactctgttccttcacgtcctcccttctcagcctcgtccaagcaccgggaagacctccaggctgaccccttgagcagcagtcagcacaggtgcgtgggggcgtgagggaggcagggtcttcaccacaggcgccttcctctgtccttcctgctctttcttctctgcccaggccgctgcagctgcacagcctctgctacacctgggctgcctgggaggcttcctggtgtggtgtctggaccccacggccttgggtcatcctgcggctggtctggggtggggtctgttgtggtccttccacggtgtcagtggcctgaagtccctcgcttttggggggggggtctctcacccccaggccacatagggccagtggtaggggttccctctatgtcgggcagtgctgagggctgggatgctctgtgaccccagctggagcccacacctaagggctggcatccacatcatttcaccctgcagtgagggaagaggccaccaggtggcagcacagccacacccgttcccacgtcagaggagggcaaggctgggtactcagcagccactctgagccggggctccttccaggagctgaaatccacctgtctccatcttccttgcctgcctgggtactcatgccaagcagagactgggattaggggttctgtgctcttgcctaattaggaacattctcccatgtctcttgtgtggtcccagaaggagaagtgagtttgccaaggatatggggcaggaggctccctctgctgaccccctgcagcctggagccagcccggggactgtcctgggtggagggcagctgtgaccattcctgggagctctttgagcctttctgtcctctgcagtgggggttgtggggggcgcagcatccacgccttgctgcccttctttcatgaagtctgttttttaagtgctggttcccccgaatattttatgcagaggagggaaaatttatagtggcaattattttctcacagtctggtgagcaggcaattaattaggagtaagggggcctagtagagcgtggcgtgtggcagaatcgcaccgccccggctccccagcccaccgccatgcagggctcgcgtgcgggaaaactaatatgccggcgtttaagcctgtgcccctctgctgggtgtaactgcgctgaaataaatgatctgacaatgtgaaaaaaaaaaaa

SEQ ID NO: 64670 - DNA, 1692 bp, Homo sapiens
acagtgtcatggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaatcagcttttacttgtcttcgctggaggagctcttggcgtggaagccccgcttggaggatggctttaatgtggccctggagcccctggcgtgtcgccagccccctctgagcagccagaggccccggactttgttgtgtcatgacatgatgggcgggtacctggatgacaggttcattcagggctcggtggtgcagactccctatgctttctaccactggcagtgcatcgacgtctttgtgtacttcagccaccacaccgtcaccattcccccagtgggctggaccaacactgcccacaggcatggggtctgcgtgctggggactttcatcacggagtggaatgaagggggaaggctctgtgaagccttcctggccggggatgagcgctcgtaccaggcagtggctgaccggctggtccagatcactcagttttttcgttttgatggctggctgatcaacatcgagaactcgctgagtctggccgctgtggggaacatgcctcctttcctgcggtacctcaccacacagctgcaccggcaggtcccagggggcctggtgctctggtatgacagcgtggtgcaaagtgggcagctcaaatggcaagacgaactcaaccagcacaacagggtcttctttgattcctgcgacggcttcttcactaactataactggcgggaggagcacttggagcggatgctggggcaggctggggagcgccgggctgatgtgtacgtgggcgtggatgtgtttgctcgagggaacgtggtcggaggccgattcgacacagacaaggtgggtggtggctttcgtccaagggccagcggcccagtgcctcccctgggacctcatttcctcatggaccttccattcccgtctgcacctcaaaggaatgacagcagctgttcttcccagagtggggatcccgtggcactgagaaacaggtgtcctgccccggccaagctatgtccccactgaaacccctttcccggctatttctacaatcagataatgtatttttgtgtgggtgttaccagacagaggcgcgtcgttcccccgctgtccggtcctcggcgggcctgggcctcctgtcccagctgcgttccttgatcttccccgtgagggaagcctgcggggacgcacaggggcctgcagcgcctctcactgcggctcaggggcgaggacgggggaggtgcccagggtttggggatcggtaggtgtcatgacgagggagcattttctggcaaggcaggacacaccagcacagaggaaggagcggggccaggccggtgcccctggcgtgggatgcgcagggctctgcctgcctctggtctatcagtcctgcccgttcccagagccccagggatgttctcagcccttaatttagctttaaatgagtaaattaatccaataactaaagagcctctttactgcccgtgat

SEQ ID NO: 64671 - DNA, 469 bp, Homo sapiens
acctgataatttcaaaatgccttcctgctttgagaatcagtgactctaataatagttcaaaaaaaagcaaaccaaccaactcttctggttatttgtatttagtgctatattgctagctttgtaagtgtttatgggtagacagaaccttgagtgctgctgatattatatcccactgtttagtgtttggccatctctattatgaacatcaaagggacttgttaaacaagtaggttcctgggctctacctcaagtactaactcagtctctgaagatagagcctaggaatctgagtctttaacaaacattcctatatatattgaaatttgagaagcactgtttagccttctttacaagatggaaagcaaaatagcttttgtttttttttttttttgagacagggtcttgctttgtcacccaggctgaagtgttgtggtgctgtcatggcttactgtgatctctgcctcctggg

SEQ ID NO: 64672 - DNA, 468 bp, Homo sapiens
tatttctctacaaaagttccttccttaaactatttatttcgtcttagtaagtttccattctctcagatattgtgatttgctaataaattccaaaaatatatttactgtttataacaaacatggtttgggaacctaaaactaaacaaatttcagtttaggccatttttactaatgattaacatttcagccataaaaagttatgagaataagagagaagtgcatctttaaaactatataatgaattatggcatgataatgttttactaaaagaactgaaatggaggtaggtagcaggtccaacctccttgtttaatagataattttttttttttttaagacagggtctctcactttttcgcacaggctggagtgcagtggcgcaaacaaggctcactgcagccttgacctctggggtcaagtgatcgtcccacctccaccccccaaaagtagcggggactacaggcgcgc

SEQ ID NO: 64673 - DNA, 523 bp, Homo sapiens
gtggctgacgcttatatcccagcactttggaggccgagcaagcagactgcctgagcccaggagttgagatcaacctgggtaacatggaaaaccccatctctacaaaaaatacaaaaataagctgggactacaggcacatgccaccacacccggctaatttttgtgggttttttttttttgagatggagtctcactctattgccaggttggagtgcagtggcgcaatcttggctcactacaacctctgcctcccgggttcgagtgattctcctgcctcagctactcgggagactgggccacgagaatggcttgaacgcgggaggcagaggttaccatgagccgagattgcatcactgcactccgtctcaaaaaaaaaaaaaaaaatgataagtgtgaactctctaatcagattgatctgatctggaattctgactctgccattctgtgattaagagaggtttgtgtccttatctttatagactgaggtgatgacctcctgagatcaagcaatcctcccacctca

SEQ ID NO: 64674 - DNA, 468 bp, Homo sapiens
ggtcaaaacatggtgcttataaccccaatcaaattaaaataatgacactgtccctttctacttagtagtgttctcagagttgcatggtatacaatgaaattaatgtaaagagaagaaaagttatataaaagaaatgagatgataatctgccttatcttgggtctaatataaaaatctacataaaaatcaagcaaatatttattgaactttaaattaggtcattaactaaaagctactaatagcttttctgattgatcaactttattcatatacacggacaagggaaaaacaaagaacaatgatcatgtttcatctcggatgaaattattaaagttgaaaggaaactaaaagggcatttattttctagaagaaaatggtctaaagttatacagggaagtacagttgaccctaggtatccaaccacagatataaaataatttggaagaaaaaaaatgaatggttgtgtct

SEQ ID NO: 64675 - DNA, 355 bp, Homo sapiens
tgtgcgtctgttcagtggcagtccccagatatcaccaacacaaccagtggatggaacaaagccgggcttattgctttcggcagtaagggggtttgtttgatggtgctatcagagggggaaaggcaaggccagattactgaaaatttgcagcttggtttaaagtccgtttttgacagggcttgataaggattgggttaggtgtcgtgatatgatgttacaggattgtgggaacaaagtcctagggcataaactgttggtgcttcctattgaagtgttaacgggtcttttgggaagtttccataatgagcaattcatttatttgtgcaggcaagaataaaagtaaagacaatggaaa

SEQ ID NO: 64676 - DNA, 913 bp, Homo sapiens
ccagagaggggcaggcttgtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatca

SEQ ID NO: 64677 - DNA, 878 bp, Homo sapiens
ccagagaggggcaggcttgtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagttgtggtggggggtagtggtggcaggacaagagaaggcattgagctttttctttcattttcctattaaaaaatacaaaaatca

SEQ ID NO: 64678 - DNA, 483 bp, Homo sapiens
aaccctgtgcccccaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccatgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatca

SEQ ID NO: 64679 - DNA, 1490 bp, Homo sapiens
ctcgcgcttgtccctcattccccacgcaggcctctagttctccatttcagaattcattctattcctgtgcccgaaataaaacccacgtttttcttgcttgtaatttaaaggttgcaagaaaaactcctcggcccctcggaccatctttcctgtttccaaatgccggggaccagtgtctgtgactgcgccgcctgcctgagggcatgtactgaaaagccctgcgactccaacatgtgggactcacaagcaccttggacaggcctcaaaacgcggctgacatacagaatttttaccattaacgacctgaggcaggactggtggaggtcagttcattagttactgatctcaagaaacaagtcaggactattttctaatgtgcttctttcaagttagtgtggaaagagctgatgcatctgttgtagctgacggaatttaaggaactgaataattgacaagatttccagaaaagcagggtcgccagataatgctacctgtttgcgaatgattgttaccgtaatgctctagagagctaatcctttctcggcctagtcagatgattttaaatcatttgattttacagagctttagtttcagttttttaaatgaaaatggggatgggattaggtcatcttctaacacccacgacagccataaattgataatctatggatccatatttaaagttactgataaaaataaccacaattgaccagcctcccttccctgttaggaaatgctttatattttaatttagcaacccatgtgaccaacccttttagaattgaactggctctccctaggaaaggttagaaatctaatcagttatagtaagtttctgttaacaaatggggagtggtcgacttggagtttggaaaaggggagcgtaaagtctaaaagtttgttaatttatctagccgttgctccaggaggacctgtgttatagtttggaaacatttacaaagggtatttttgtggggcagaaaacagttagcagtccttaatgtaatttggttgaaataaccgttcaaaccagactcctcctgttgctttgattcctttttcgcaaactttcttatgttctacgtatccaggtgctcctgatggccagcaatagacttgagacattggaagaatgtatagccttagcgtctatttagtgttaagattttgtaagtctaattactgtgaaatagtcctggtaactttatcgattctggatacaaagaaaaatgcaaagtgaaagacctttggaaattgctattcacaccagagtactctatgagacattacataggtgatcaagaagagtgatcacctggctgcactttagggtatgtttgtccaggtttttctaataagttaattctaatcaataacttttgttctaattagtaacttttgtataaatgttaatgttaaatcgcgaaacaatgtgggatgggatactaagttctctccaggaacatgaaatgtcagcccgtttattcaca

SEQ ID NO: 64680 - DNA, 3647 bp, Homo sapiens
ttggcggcgcctaggctgtatcgcagcgagagcgtttttgcctgtggagagccggccgacgggagccgcggcggagcctgttgagctcgcgcgggctgccgggagtggtctctgaggcggcggcggcggcggggatcgtctccggcactggcgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgagaccatcctccagtgggtgaagcacgacctggagccacggaaggtccacttgcccgagctcctccgcagcgtgcgtctggccttgctgccgtccgactgcctgcaggaggccatctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacatagcacaaaggacgtgccatggtgctttccccaaaagttgtgttgcttttatcagttttctaacttaataaaaagagttgagaaaattcaaaaaat

SEQ ID NO: 64681 - DNA, 2321 bp, Homo sapiens
aggatccttaattaaattaatccccctcccttcccccttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacatagcacaaaggacgtgccatggtgctttccccaaaagttgtgttgcttttatcagttttctaacttaataaaaagagttgagaaaattcaaaaaat

SEQ ID NO: 64682 - DNA, 3571 bp, Homo sapiens
ttggcggcgcctaggctgtatcgcagcgagagcgtttttgcctgtggagagccggccgacgggagccgcggcggagcctgttgagctcgcgcgggctgccgggagtggtctctgaggcggcggcggcggcggggatcgtctccggcactggcgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgagaccatcctccagtgggtgaagcacgacctggagccacggaaggtccacttgcccgagctcctccgcagcgtgcgtctggccttgctgccgtccgactgcctgcaggaggccatctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcaggagcctggccgcggggactgcagggagggtgcctggacccgtggggttgcttcattgagataaagcacacttatcacatagcacaaaggacgtgccatggtgctttccccaaaagttgtgttgcttttatcagttttctaacttaataaaaagagttgagaaaattcaaaaaat

SEQ ID NO: 64683 - DNA, 3572 bp, Homo sapiens
ttggcggcgcctaggctgtatcgcagcgagagcgtttttgcctgtggagagccggccgacgggagccgcggcggagcctgttgagctcgcgcgggctgccgggagtggtctctgaggcggcggcggcggcggggatcgtctccggcactggcgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgagaccatcctccagtgggtgaagcacgacctggagccacggaaggtccacttgcccgagctcctccgcagcgtgcgtctggccttgctgccgtccgactgcctgcaggaggccatctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagaccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacatagcacaaaggacgtgccatggtgctttccccaaaagttgtgttgcttttatcagttttctaacttaataaaaagagttgagaaaattcaaaaaat

SEQ ID NO: 64684 - DNA, 1319 bp, Homo sapiens
gtctgtgcatcggaggctcgttagcagcatccttggcctctacctgctgggtgccggtcgcatctcttccccatttgtggcaacccaaaatgtcatctggggaacaacatcgctctgttgagaaccaccgccctagaagagccccctgtgtggaggggaccataggtttaccccaaaaactcctcggtgaacctttgtcatctggcattttactgtccctgtgggcagggactgtgcttcgttcgtcctttgatgtgtatgtcctgccacctctggtacacctgaaaactggttttttaaaatggaagccagattatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaaattgagaattatccaacttgttataagaaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatc

SEQ ID NO: 64685 - DNA, 1193 bp, Homo sapiens
  misc_feature (20)..(20): n is a, c, g, or t
  misc_feature (22)..(22): n is a, c, g, or t
  misc_feature (24)..(24): n is a, c, g, or t
  misc_feature (26)..(26): n is a, c, g, or t
ataggcagtacgaggccttngngnanttaggcggattcttggcgccggaggaagaggcagggtcaccctctctccacgtcagagacctgactgtggagatggcggctcagaagataaacgaggggctggaacacctcgccaaagcagagaaatacctgaaaactggttttttaaaatggaagccagattatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaaattgagaattatccaacttgttataagaaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatc

SEQ ID NO: 64686 - DNA, 315 bp, Homo sapiens
gtaggcaagaaggctaactagagatgcctggcatttgtccccccagactaaaaaggaccaaggctacaaataaacaactaagatttgatttgagtgttgaagatagagtgctgcagtgtggcaagggagtgaagatgcatctgtaatgacaggagggcagcatggaagcacatagcctctataaccccatctccccgacctggatcagatctgcctggcgtcggagggaactttccatcatgggaaaaaggtaagcagaatatcaccaccaacccccattgccaccacaaatgcctacagtccttcaaacagaag

SEQ ID NO: 64687 - DNA, 823 bp, Homo sapiens
actctagttgttctttttaatttatttttacaaaagtgttgtgtacaaatgtaatttagttacatgcatagactgcatagtggcgaagtcagggcttttagggtatccatcattcaaataatttacattataacccttaagtaatttctcattatccagcacccaccctaccttctcacccttttacttcaggtttgctgggcctcaatgacaaataaaacaaagataaattaattgttttctgggagttagaattaaaaatcaacctaagagaaaagatgactcctaagccaaaatttgtgatatatatatatatatatatgtgtgtgtatatatacacacacacacagaaacatgtttctgtgtgtgtgtgtgtgtgtgtatatatttgtttatactcaagaaacttatccagtctttccctctgcacaaatccaaaattaaagccaaatggttctatgtgataaacatcatggtaataacttcaaaaaacaaaaaaaaaagcttcctccagtgaatgtaaatttaaaaaaatgaaacaactgtttctccagatgtgcagaaatcaatataaagacacataaagacagagaaaacacagaaaagcaaggtttatgacactttcaaaggaacacaataattctccagtattccaagaaaaaaaaaataattgaaaggactttaaaagacttttagaaggcttcaaaatatagattttaaagaagctcaaagagatgcaaaagaaatctaaaaaccaatacaaaaataaataaataaatttagagtatgaatgggaaatgtgccaaggagataaatatctttt

SEQ ID NO: 64688 - DNA, 537 bp, Homo sapiens
ctgtaatgattcaaatccttcaccaaagaggtaattacagcttccttggtaagagcagagctcaggcagacagacaggtggtttctagtttctcttataacagatggcacaaatggaccagcttctgaagctttttgaggaaatttgctcataaacagttttaaatatttttcttttatatcttccaacacatgcttcttaaagtaaaaatgcttcagtagattgcaggcaagggcacatattatgaatagtgctgcacggggcagggtgcttgcagtttgcctgagtagcagatgcagcatgtcaggaacataagagggaggctctgtgcgccatggtggctagatatacattgaattttcgaagtgcttaaggaaaaaacaaagctgtccaccaagaattttatgatcagcaaaactattcttctcaaatgaaagtgaaataaagatattcccagacaatttctagaagaaagcataggagaaaatgtgtaggttaggcaaatacttagatttaacatcaaaagcacaatttaaa

SEQ ID NO: 64689 - DNA, 717 bp, Homo sapiens
  misc_feature (23)..(23): n is a, c, g, or t
cggcctggtacggccagcgtatntgatatcgtcgaccacgccgtcggcagcagcagcgcgtctccttcagctccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttgtctgcctgtacttcatggggggacggctccacccagcctgcgccactgtgttcttaagaggcttccagagaaaacggcacaccaatcaataaagaactgagcagaaa

SEQ ID NO: 64690 - DNA, 1331 bp, Homo sapiens
gttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttgtctgcctgtacttcatggggggacggctccacccagcctgcgccactgtgttcttaagaggcttccagagaaaacggcacaccaatcaataaagaactgagcagaaaccaacagtgtgcttttaataaaggacctctagctgtgcaggatgcaaacgtctcggggtcagtgactgcctcctgcccctgttggtccctaggcagtgggggcagaagctcccagctgacctgtttctctgggatgagagggaggagagaagggcagttagcaggggcagctgttgcagatgggaggaatagtctcccacaaaaaaggtttcagtgacagacacggggtctctaaaaatagtcatgctgagagcctaatggcccttggcacaattgctggtgttggggtagaagatgtcttggagtttgctcaagtggttgagagggagggaggtgccatcgacttggaggaactggcaccaagccagggagatagacatcc

SEQ ID NO: 64691 - DNA, 945 bp, Homo sapiens
gttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttgtctgcctgtacttcatggggggacggctccacccagcctgcgccactgtgttcttaagaggcttccagagaaaagggggaaactgaacagtcctggtgaagat

SEQ ID NO: 64692 - DNA, 949 bp, Homo sapiens
gttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttgtctgcctgtacttcatggggggacggctccacccagcctgcgccactgtgttcttaagaggcttccagagaaaacggcacaccaatcaataaagaactgagcagaaa

SEQ ID NO: 64693 - DNA, 977 bp, Homo sapiens
gttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttgtctgcctgtacttcatggggggacggctccacccagcctgcgccactgtgttcttaagaggcttccagagaaaacggcacaccaatcaataaagaactgagcagaaaaaattcactggccgtcgttttcccgtcg

SEQ ID NO: 64694 - DNA, 387 bp, Homo sapiens
ctgtctcaaaaaaagttttctcttaactactctctttttctttccaaatcatccttcttattgatgctactcttagtccaaacaaacatctgtttcttttctgatttccgattttcaggctggctggagtttgtgggaccaggaatgctgcctgatgaaaggttccttggaattttcccatagaggacaatcttttgcctgccacccatgaatgtttctgtctttcctttttttctttctttccttcattccacagatatttattaagttcttctcaagctctcaaatatcctaaacttaatttgtgtaaatattgctacagcccaggtcacagtgaaatcttagactgagacaccaccttctatttacacaggcagcatgaactgt

SEQ ID NO: 64695 - DNA, 372 bp, Homo sapiens
cctcgctgcggagcacagcctgccagaaagctctccccagttagaagccttcagaccctgtgttttgttttgggggagggggtcgtttttgttttcttggtaacagctttattgagatataattcacgtaccgtaagattcaccccctttaacatgtacaattcagtggttttgaccatactcacagagttgtgcagccatcaccactttcttcagaacattttcatcaccccaaaaataaatcccatccccattagcattcactccccattctcctctcccccggcccctgacaatctacttgcatcttcatggatttgcttgttgtggacatttcctataaattgaatcataaaacatgcagtcctttat

SEQ ID NO: 64696 - DNA, 442 bp, Homo sapiens
tataccctctatatttccatttttcagtgtttatcctacatctgaatgtgtaaccttaactaagtctattgttaatcaatatttttgcctcctgctgaagcacacaaggagggaccttagaacattttagaccacctccttccaacttaagtgttattgtgtgaaaccatttcatttctgttatgtttttaccccacaaattagacatagttattgttctaattattatttcatatagccttatttgtttagatttatccatatatttatagatatgtatttcttttattctttcttgcattttagcataattgcaataataattttatttgtgctcgaacaaaatcatttagatattttactttagtgagggtctactggttgtaagtaataaattttctcacttttgttttgatttgtttaacagtgtttttgttttact

SEQ ID NO: 64697 - DNA, 351 bp, Homo sapiens
gtaatcccagctactcaggaggctgaggcacaagaattgcttgaacacgggaggcagaggttgcagtgagccgagatcaagccattacactctagactggatgacagaccacgactccgtctcaaaaaaaaaaagtattagaaacatgaactatgccagtacagatttttgcaaattgtgagatataagtgatccaattacaaacttaaaaacagaatcaagaaagtaagaagggaaagaagaaaagttggaagggagaaaatacaagggcaacaccatctcttcagaaatcctgtcagttcataaacaactaaattgagcaaatgccttcgaatttggcaactattttta

SEQ ID NO: 64698 - DNA, 247 bp, Homo sapiens
attcttttaataatttagttttagcagtcctatgaaccaattatctatttggttaacaatctgggaaaattatatacaaatatattttaaatgaataaatgttggaaaaattctcgaagcaggtattatgagtcttttttttttagcaatttttattatatatgagagtctgattttttggtaaaacatgatactagagaaagaaaatattttacatgcaaatacttggattatacacaaccattta

SEQ ID NO: 64699 - DNA, 399 bp, Homo sapiens
cattttattcttcaaattagatggatggatggatggatggatggatggatggatggatggatggggcattagatttaagtccacccagcaatttaaaatttctcactcggtcagacacagtagctcaagcctgtaaccccagcactttggaggcccaagcgggaggactgcctgaggccaggagttcaggactagcttgggcaacatagtgagattctgtctctacaaaaactttaaaaattagccaggcatggtggcagacacctatagtcccagctacttgggaggctgaggcagaaggattccttgagcccaggagttcaaggctgcagtgagctatgatggcaccactgcactccagcctgggcaagagagaaaccttgtctctatttaaaacaa

SEQ ID NO: 64700 - DNA, 112 bp, Homo sapiens
aaataacaattttattctttttaataaataagacctcagtaggcggacctgataacagtgacaatgaaaggaaaatagtggcaaaatgtgagtttccagcatgatgtttctc

SEQ ID NO: 64701 - DNA, 310 bp, Homo sapiens
  misc_feature (58)..(58): n is a, c, g, or t
  misc_feature (85)..(85): n is a, c, g, or t
gaaatgcttgagttaaggctattccttcatataaaaataatctcacaaaacattccantgctttctcaatagaataataaatctnctaatgaatacagtctgaattgatacaatatggagctaaaataacagtagagcttgaactggctgcttaagtgacagttgaaatggcgtgtttgtcagcgtagaaatgaaaaacaatatcatgcagggaggtaatctagtcccagaggcactatggactataaatgttaaattacaatagacccagaatataaccttgcataattcttgaataaaggatataagg

SEQ ID NO: 64702 - DNA, 494 bp, Homo sapiens
attgtattactgactagctcctatccatgctttaagacacaatttaaattttagaaacttttaattatggatattgtccaaacatacacagaagtagagagaataatataataaaccccatgcatccatcacccaactttagagtatcattttgcaaatttttcaaccatgatttttttttccaactcagtcttcactggagtcctccatgacctctctaagcaaagtgagccactcttttcctgtgttctctttagcaccttgaccatcctgctattagaatgcctgcaaatataattcctcatttacctgtctctccctctacaatgtgaatcctttagggtaggtaccaagctcttttcacctgttctctatgcctagcatagatgccaacacatcataggtgttaaatatatgtgaatgaaagtaataacctcttatcttcttcatccccacttgctgtcaccctttctttccttcacagaaatagcaaa

SEQ ID NO: 64703 - DNA, 343 bp, Homo sapiens
catatgtcaccctctccactacactgtcatcatgagggaagagctctgtgtcttcttagtggctgtatcttggattctgtcttgtgccagctccctctctcacacccttctcctgacccggctgtctttctgtgctgcgaacaccatcccccatgtcttctgtgaccttgctgccctgctcaagctgtcctgctcagatatcttcctcaatgagctggtcatgttcacagtaggggtggtggtcattaccctgccattcatgtgtatcctggtatcatatggctacattggggccaccatcctgagggtcccttcaaccaaagggatccacaaagcattgtcc

SEQ ID NO: 64704 - DNA, 383 bp, Homo sapiens
cctagaaacacctattcatgccttcttccttcctggaagccctaggagtttcctggggttccttgagctatggcaaccccatatgtatgattccaaatttagacagaggagtgtaacctgtgtcctagtgtgcaagcccaggaaagagaattagcaccaatatgtgatactaaacacttgacaatctttccctcatttaattcctacgacaaaactaggtaatactgtcattatcaacaatttgcagatagggcttagagactctgaaatctgaagtccatgcctttggctactccaccataatttctcctaggatttagtagtttttattccttgaaacattggcaacgaatggcctactatattattatgctgaattccct

SEQ ID NO: 64705 - DNA, 376 bp, Homo sapiens
ggtggttttgacatgtagaaaataagatggaaggctgaactagggcagtggtgttggcaaataatcagatttcaggaatatcacaaagtgaggagcccaggattcatgaccattttgatgtaggaataagggaggagcctaggatgactcccccaagtttctggcccgagtaactgggatatcaacaagtcatttagcaaaatagagaaaataggagaagcagcaatttgagatagagatagaggcaatataaagaattatatattgaacatggtaaatcacctaaattcagaaagttgtagaaaacttgggtctggagctcaggaaagacactggatatgtagatttggaagttatcaatctcaaagtgatgctt

SEQ ID NO: 64706 - DNA, 368 bp, Homo sapiens
caaattaattttgtctttacccctctttgtccgaaaaactaaggctaaaagcagtagcatttctaccatccctccctcactcagtccattctcaggaaacacagagcccaaaggaagtatccaaaggaaaatgatacgaaattctaatgcttaggtactacttcaggtaccagtgctatagaaaaagaccaaagagaaataattggtggacaggcgcagtgactcatgcctgtcatcccagcactttgggaggccgaggcaggtggatcacttgaggccaggagttcgagcccagccaggccaacatggtgaaaccctgtcttcactaaaaatacaaaaactagccaggcatgatggcaggtgcctgt

SEQ ID NO: 64707 - DNA, 870 bp, Homo sapiens
ttgtctgatttgctctgcacagcattaaatgttttaagagttcctactctggagccaccaggttcacatcttggctctccagtttaccaagctgcatggttatgagcaaattacctaaagtctgtgtgccttagtgtcctcatctgcaaaatgggttgatacccacttcatagagctcagaggattaaataagttactttatgtaattcccttagaatagagctttgcttttgtttttgtttgtttgttttgagacagggtcttgccctgttgcccaggctggagtgcagtggcgcaatcacagctcactgcagccttgacctctaaagcccaagtagtctacttgggaggctgaggcaggagaatcgcttgaacctgggaggcggaagttgcagttagcagagatcatgccattgcactctagcctgggcgacggagtgagaccccatctcaaaaataaaaaaaaaaaagaaagaaaaagtttgcagatgaaaacttcccattgacttctctttttgcccagagttaagccaacagtactattacttgtaattatcttcctatatagctagttgaaagattatggtgtgtatatatagagagagaagttgaatttttataccaaaacactttctcctaatatgatgtgcaggaacaaaacattttttacatcaactattcccttttcctaaggcaggtgaataatcttgttttttatctgtacaattgaaatattagaatataccaaagacacattagataaaataggtgagactagatattcatgaagtcattactttattcccagagctttactgaggtataattgacatttagtgcatatccatatttaaatgtggatgtttaggt

SEQ ID NO: 64708 - DNA, 580 bp, Homo sapiens
ttgtctgatttgctctgcacagcattaaatgttttaagagttcctactctggagccaccaggttcacatcttggctctccagtttaccaagctgcatggttatgagcaaattacctaaagtctgtgtgccttagtgtcctcatctgcaaaatgggttgatacccacttcatagagctcagaggattaaataagttactttatgtaattcccttagaatagagctttgcttttgtttttgtttgtttgttttgagacagggtcttgccctgttgcccaggctggagtgcagtggcgcaatcacagctcactgcagccttgacctctaaagcccaagtagtcctaccacctcagcctcccaagtagctgggaatacaggcgcataccaccacacctggctaatgtttgtattttttttagagacagggttcctgttgcccaggctggaagcttggtgtagtctgacaatgataaagatgatagttaattatttagcacatgattttatagatggaaaaactaagaccaaaggtatgaaaagtaattggagtgggagaaaaccataaaactagaaaaaatcaa

SEQ ID NO: 64709 - DNA, 387 bp, Homo sapiens
tcagtaggctgaggtgggaggattgcttgaacccaggaattcaagaccagcctgggcaacatagcaaagacccatttcttccaccccatgaatgaatgaatgagttattaatttaagtttaagggcaaaagctaataactaataggggcacagtatataaggatgtggttttgtgacatcagtaaccaaaaggggtagagacagagctgtaaaggagcagattctttgaatagtagtgaagtcaaactggtattaattaaaaatagaatttaacttcaggatattagatgtaatccctatgataaccataaagacaagatctatagtatatatacagaaggaaatgagaaaggaatttacacatttcaccaaataaatgtatctaag

SEQ ID NO: 64710 - DNA, 399 bp, Homo sapiens
atggaaaccatgactaaggacaagtcggtaataatcttccaacttacatttatacaacatgtttggtgcctttgtaagaatcaaccaaggaaacatcttttttatgttttggacagactataaagggatagtctgaaaaagcacagatcataaaataacaacctataaattttctatataaaggatacagctgtattgcagcaaataaatctcttcaaacacaaatatctaatttgacttgttttgtttacgttaatgaggcaacaatttacaaactgccaaaacatgtactgttttggtttgtacaagtaaaaaaaattatttaaatctcatttttcccagagagaaatgacagatttgagctttctcagggtgagctcctaagaacgaataaggcta

SEQ ID NO: 64711 - DNA, 1728 bp, Homo sapiens
atgctgcaacaacagatgtgactaggaacggccggtgacatggggagggcctatcaccctattcttgggggctgcttcttcacagtgatcatgaagcctagcagcaaatcccacctccccacacgcacacggccagcctggagcccacagaagggtcctcctgcagccagtggagcttggtccagcctccagtccacccctaacaggcttaaggatagaaacgacacataacaccgggaaaagccatgctgtcaagcatctcagaatctcaaccccagaggcagtctttagggactggggtgggctcaggaagctgtattatttcaaaggacgcagtgtttccacagctcagcccagagctgctggagttcacacggcccaccagaacctgctgacttcaaaatcatcaccaccaaggggccaggaggtggcgctgtggggcaacagaaaacagaaaacagctgctccttgaacttggattcccagcagctcccccaagcgcccacaggggctgcattcctccctgctggacacctgtaactacaacattaaaacagggcgcaagcaaggaacacaaacactgggaaagctgtgcctttaaaaaaaaaaaaaggagggtaaaaaagcttaaggttaatgttttgaaacctgacccagccagggcctaatgcagaccttgtccagctagtaagtgggcctctgggggtcttcattgagtgaaccttcagagtgctggtgtttcaccaaggccttccatagaggacgcggcaggctctgcaggaagcagcttcgatggccgatggccaagaaaggaagggaaaacccctggactggtcgctgggcacccagtccccctacccccgtgccttcccttccagtgcctttccctctttccctcggtggtagctttgcctgacagtgcagacctcgcctgacgtcaacactaggttctttatgctcatgtggttttatttttgttttctcctatcaagagtggtcagaaaatctctgttccatgtcaggaacaaggaaaatcttttggaatttttttggtttttttcttttttttagcatgacttgatcagataggtaggataatgttgcccccttggcccaagtgcagagtgacaaaagggaccaacactaaaaggatccctgagatcctgggatacttcctcttcatgttcattgtgggggccggggacatcaccctgacaggtgggtccccaggccccagaaagctcatttccgcatccctgggtgcagggggagttcacggggtctctgcctgttggtttgggatgcgtctcctcaaggcactcactgtccagagagaacaaaaataaaaccaggtctgctctctggctctgtcatctgggcacgttcggagccaaaagccttgaccttctgaaagttcactgaaaaatcatctcgtaaaaggcagattcattggacaaaagatttagaaatgtgtttaccgtgtatacatgggagccttcagaatacagacccacagatgcagggaaattgtccatttttatgcttaggttcaagaaagggtggactgcgtgtggaaagaagattatataacaaggccggacctgctgctaataggctgagtggggaacctagcaaggtctgtctgcctggattcttcttggcctttcctcctccgagaatggggcgggatgctctctggagtgagggtcttatgacctaaagtcaaac

SEQ ID NO: 64712 - DNA, 1593 bp, Homo sapiens
acacaccccctcagtaccccccaccccctttttaagcaatgctttgttgtgctaaaactagttggacgagttagggtgttactgttgctcccgaggccctggccaatagaaccagatccaccccgctgtgcgtaagcgcgcaattaaggatttaaccaaggctgtgctgcgcctcagccagcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatg

SEQ ID NO: 64713 - DNA, 1636 bp, Homo sapiens
acacaccccctcagtaccccccaccccctttttaagcaatgctttgttgtgctaaaactagttggacgagttagggtgttactgttgctcccgaggccctggccaatagaaccagatccaccccgctgtgcgtaagcgcgcaattaaggatttaaccaaggctgtgctgcgcctcagccagcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcggaatgtttctgaaaaatacttcattctgcccctctg

SEQ ID NO: 64714 - DNA, 946 bp, Homo sapiens
cgagctcggtaccctgccaaagcgtagtacccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcggaatgtttctgaaaaatacttcattctgcccctctg

SEQ ID NO: 64715 - DNA, 910 bp, Homo sapiens
aagcaacgaccgcaagagctgaatcccagatgccaaggagaaagcagtgttgtaggaagcgctttgcacaaactatctgaatgaacagagtaggaattaatcagaggctatcccgcttttccatatttggggtaggtgcatatttatcgcggtcctgaaaagcaaaggtggtggtgatatgggcaaagaatgaagactgagtggtaagaaactctaggactctatttgaggcccttccgcaaaaggggcattgtctggtgacaagctttaactgagtctgttttgattatttagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtaaatacggcgctgccatgcactagacctgcctgagctgcacgtctggttgggtcgcgcggttcagtctcgatgggactggagctgtttcgacagtacccgtgagaaactaacagacccaaagacatcagcccctatgctttaactcggtgagtcaggccttgagacggtggggatggtattcatcagcggtctggagatacctcccactaaccgcgccccccgcccccaccccgtagcgggcctccggagctgtggggccaatttcgcgggttgaaagcaagcggagggttatttctagggcggcctaggcagcccagagcagctatctggttttcttaacaatgtagagcctcctcgggggtgagcaaggcctggtgttctcgcggtggtctcaggctaagaaaaggctgagaacgtcgcctggagcg

SEQ ID NO: 64716 - DNA, 1136 bp, Homo sapiens
acacaccccctcagtaccccccaccccctttttaagcaatgctttgttgtgctaaaactagttggacgagttagggtgttactgttgctcccgaggccctggccaatagaaccagatccaccccgctgtgcgtaagcgcgcaattaaggatttaaccaaggctgtgctgcgcctcagccagcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtaaatacggcgctgccatgcactagacctgcctgagctgcacgtctggttgggtcgcgcggttcagtctcgatgggactggagctgtttcgacagtacccgtgagaaactaacagacccaaagacatcagcccctatgctttaactcggtgagtcaggccttgagacggtggggatggtattcatcagcggtctggagatacctccca

SEQ ID NO: 64717 - DNA, 1440 bp, Homo sapiens
cggtgctcgctcctctgcgcggtccgcgggcggctgcttctctcctcctgcgcttctgctccgcggtcgctggcccaggcgtgtgtgcgtgagaccccgaaggagcctgtaccacgatgaactagggttatgtctgggcggtcgtggaggaacaagctaatgcatcagcccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcggaatgtttctgaaaaatacttcattctgcccctctg

SEQ ID NO: 64718 - DNA, 893 bp, Homo sapiens
ggaaaaccccatgtggcaacacgccttctgtgtacattcccaatatttgctataaatagggccatcccaggctgctgtcagaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatattga

SEQ ID NO: 64719 - DNA, 789 bp, Homo sapiens
ggaaaaccccatgtggcaacacgccttctgtgtacattcccaatatttgctataaatagggccatcccaggctgctgtcagaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagttaaatttagggttgatgcataataaatttagggttgatggggtactctggacagctagcagc

SEQ ID NO: 64720 - DNA, 448 bp, Homo sapiens
ggaaaaccccatgtggcaacacgccttctgtgtacattcccaatatttgctataaatagggccatcccaggctgctgtcagaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatgtaagttattaattgattttaattcagttgtatcaggaatacctagaaacttcagttttaaaaatgtttgcctttttagagtttcattcagaaattactgatgttttg

SEQ ID NO: 64721 - DNA, 508 bp, Homo sapiens
tacatacatattctatgtaaccaccaatagcaaaattatatgacaattctgggactttatcttcctgccattgtactattatttgttacattgcagagaaagagagaatcactttgattttgcattaatcttcatcagaagcattttttgtgcattttattttacctcatcaactgaaatgtttagtgtgtaatcaactggaatataaaatttccattgtatgttctatgaaaaacccattgaaaagctcattaaacacaaatcaaattttctgatttttcagctttcacacaaagaaaaagttgtctgtgtgcgcaaatccaaaacagacttgggtgaaatatattgtgcgtctcctcaggtatgttacactgacatttagcctttgcaaatgtttgaggaaagaggagtgtgcaaaggggtgggccgtaggttttctgggattctttagtttaactattgtggaatttttaaagggaaaatttgagttggaccacaaaaacaaaga

SEQ ID NO: 64722 - DNA, 867 bp, Homo sapiens
  misc_feature (862)..(863): n is a, c, g, or t
  misc_feature (865)..(867): n is a, c, g, or t
ggaaaaccccatgtggcaacacgccttctgtgtacattcccaatatttgctataaatagggccatcccaggctgctgtcagaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatattgaaaataaagaaacaaaaagttcttctgttaaannannn

SEQ ID NO: 64723 - DNA, 930 bp, Homo sapiens
  misc_feature (925)..(926): n is a, c, g, or t
  misc_feature (928)..(930): n is a, c, g, or t
ggaaaaccccatgtggcaacacgccttctgtgtacattcccaatatttgctataaatagggccatcccaggctgctgtcagaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatattgaaaataaagaaacaaaaagttcttctgttaaannannn

SEQ ID NO: 64724 - DNA, 11216 bp, Homo sapiens
gcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtgaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcacatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaaaaaaaaaa

SEQ ID NO: 64725 - DNA, 474 bp, Homo sapiens
cactttgttacgtatgatttctctcttttcttacaatctgtctctctataattacttgtaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaactaatgagaccaaagccagtgctttcctaccttcagcagatacctttatttagcatcttttagatcatggtgtctggctcttaaatgtccccc

SEQ ID NO: 64726 - DNA, 1850 bp, Homo sapiens
gcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagccacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctct

SEQ ID NO: 64727 - DNA, 1167 bp, Homo sapiens
gcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattg

SEQ ID NO: 64728 - DNA, 577 bp, Homo sapiens
  misc_feature (16)..(16): n is a, c, g, or t
  misc_feature (37)..(37): n is a, c, g, or t
cagaggatcccatgcnaataacctccaagacactacnacagctgaaaacaaggatgagcccagcgggaaacgctgaaagcatccactatgcgttgaactgctgtggtttggctgggggcgtggaacagaatacaagcagctgaatcagatgaattactaagccacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctct

SEQ ID NO: 64729 - DNA, 917 bp, Homo sapiens
gcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattg

SEQ ID NO: 64730 - DNA, 2100 bp, Homo sapiens
gcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagccacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctct

SEQ ID NO: 64731 - DNA, 595 bp, Homo sapiens
cccagctcattgctccaggagagagaagagttcaaaaaataaagtaatcataaacttgaactctctccattctcttgttcccatttacaggtgaatctcttcctttaagccatttttgtctcctgtgaatacagccttatctccacctgtttcttagatcccatctcccctggcttattttttccattcattaccctctttgttccctttacttctcaacctgtgctatatacatgctgttctctctgttgagattgccttatttccatctaacattctctctcctgctattctgatttgtcattcacaactgatttcaagagtcaccttcaccaggaagtcttccttgaccaccatcattcctgcctgattagagggcttcctcatggtaatatgtgttctcaagttttcagtgtcaaggaatgccatcccagaagctcattctcagatgcacaacagccagaacagtctcaagcagcattctagagcttggaatttaagaactacgcattgcctataaagtgaaacataggctaatatagattaaattgaatattgaataaaaaatatatttatttatccacatctttgtatc

SEQ ID NO: 64732 - DNA, 559 bp, Homo sapiens
aacaggtggtgtttgtatatgagtaagttctttagtggtgatttgtgagattttggtgcactcatcacctgagcaatgtgcactgcatcctatttgttgtcttttactcctcactcccttcccacactttcccctggcttattttttccattcattaccctctttgttccctttacttctcaacctgtgctatatacatgctgttctctctgttgagattgccttatttccatctaacattctctctcctgctattctgatttgtcattcacaactgatttcaagagtcaccttcaccaggaagtcttccttgaccaccatcattcctgcctgattagagggcttcctcatggtaatatgtgttctcaagttttcagtgtcaaggaatgccatcccagaagctcattctcagatgcacaacagccagaacagtctcaagcagcattctagagcttggaatttaagaactacgcattgcctataaagtgaaacataggctaatatagattaaattgaatattgaataaaaaatatatttatttatccacatctttgtatc

SEQ ID NO: 64733 - DNA, 354 bp, Homo sapiens
gcaagttttttcaaattgtcacaaatctgctgggcatgttgctgtgcacctgtaatcctagccacttggtaggccaaggcaggaggattgcttgaacccaggcatttgaggctgtactgtgctatgttcacacctgggaatagtcactgcacctctagcctggacgatatatccttatatagcaagaccctatctcttaaaaaaaaaatcatttggccggctactgtggctcatggctgtaatcctagcactttgggaggttgaggtgggtggatcacttgagcccgagagttcgagatcagcctgggcaacatagtaagacccctgtatctacaagaaatagaagaaaaatta

SEQ ID NO: 64734 - DNA, 529 bp, Homo sapiens
atcatggcgctcctccatgcattttcaaaaaatatcaaaaaatatctaactgtataattagcataagaaaattccttataaacctctgacatttctcacgaggctacctcgaggcattttcagaaatatcaaatatcaggttcgttcctccacacagtgtcactgtcgttgttgtttttggtgcctgcttcctctgcatcctgggcatctggccctgggcttgcctcccgggcccaggaggggaggggagtggaggctttggagaaggcagaggctcagaggctggacgcctgggttctgtggagctcacgcctgtccacccttcctctccaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaa

SEQ ID NO: 64735 - DNA, 859 bp, Homo sapiens
acgagagagggcgcggccaactccaggtgggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaa

SEQ ID NO: 64736 - DNA, 442 bp, Homo sapiens
aggctagtacgaggctggtggtgcaatgccgttggcgggaatgtcggggcagggcgccagtccccgagggggtggccctctcatcctgctggatcttaatgatgagaacagcaaccagagtttccattcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtgacccctgagaagccggcctgcctgtcctgttgccccaggggcccctttggctttttacaaataaagacccttttgtaa

SEQ ID NO: 64737 - DNA, 537 bp, Homo sapiens
tcattttatttaagtaatgtacattttatttaagtcatgtgatggattttcacagaatacatatgcccagggaaccagcaccagattacacaacagaactggatcagctcccagaaggaggtgagagaggccagaaggctggactcctgggtcttggagggaatgggggatctgggcagtcgaaggcttggagcctgcgtcctgagggcctggaggagaggcagacctgggacagagctgaaggcttaggggctgggttcttgggatttctgtcctcttgcatttgcctgtggatttgcagttggtaatggcgttcttgcccggccctcctttgttcctccaggcagccaggcagctgtggcgtagtgaaagggcaggatgcgggataggaatggagttattcctgattcagactgatttgctctaactgtgatttggggcaagtcccttcccctgtctagaccttagctggctgccgcatctaaaaaatggagccaataatcttttcctcgtctttggggtcatccatctttcaac

SEQ ID NO: 64738 - DNA, 444 bp, Homo sapiens
  misc_feature (33)..(33): n is a, c, g, or t
  misc_feature (143)..(143): n is a, c, g, or t
aaactcctgacctcaggtgaatctgcccgtctnagtgccccaaagtgttgagattacaggtgtgagccactgcgcccagccatttattttaaattttttgaggaaccactatactgttttccatggtggctacaccatttttnactcccaccaacagtatctaagggtaccagtttctgtcctcttgcatttgcctgtggatttgcagttggtaatggcgttcttgcccggccctcctttgttcctccaggcagccaggcagctgtggcgtagtgaaagggcaggatgcgggataggaatggagttattcctgattcagactgatttgctctaactgtgatttggggcaagtcccttcccctgtctagaccttagctggctgccgcatctaaaaaatggagccaataatcttttcctcgtctttggggtcatccatctttcaac

SEQ ID NO: 64739 - DNA, 672 bp, Homo sapiens
  misc_feature (11)..(11): n is a, c, g, or t
  misc_feature (15)..(15): n is a, c, g, or t
aatctgaagtnggancggccgccgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaa

SEQ ID NO: 64740 - DNA, 1182 bp, Homo sapiens
tcattttatttaagtaatgtacattttatttaagtcatgtgatggattttcacagaatacatatgcccagggaaccagcaccagattacacaacagaactggatcagctcccagaagctctcccctcgtcccctcccaaccctaagggcgatcactatcttgactttggtgcactataaattagttttgtctggttctgaacgtaatacacctggaaccatctagtatgtactgttgcatttggcttctgtcactcaagatttcatcatgcgacttgtctatgttgctgtgtgtagccgggcatgtcaatcccgttgctgtgtctatgtgcatggtagtgagtagggcatcattcattttccattctgttgatgggttatttccagtttggggctgttatgaaagggctctgaacattcccatgcaccctcttgatgctcacacctacacatttctgctgggtgttgacagcctaggagtggaactgctggatcacagaggtggcatatgttcggcttcattagaaaactgccagttttccaaaatgtctctaccaatttacactcccccagaaatacaagagaggtccagtcgctctactttctcgcctccacacggtgcggtctttttcactttagccattctggtggtggagacccactcgtattcgcagcgcatcccgggggcataactgctggcagcaccgacgaacccccaatgctgaccaaggaggagcctgttccagaactgctggaagctgaggaggtgagagaggccagaaggctggactcctgggtcttggagggaatgggggatctgggcagtcgaaggcttggagcctgcgtcctgagggcctggaggagaggcagacctgggacagagctgaaggcttaggggctgggttcttgggatttctgtcctcttgcatttgcctgtggatttgcagttggtaatggcgttcttgcccggccctcctttgttcctccaggcagccaggcagctgtggcgtagtgaaagggcaggatgcgggataggaatggagttattcctgattcagactgatttgctctaactgtgatttggggcaagtcccttcccctgtctagaccttagctggctgccgcatctaaaaaatggagccaataatcttttcctcgtctttggggtcatccatctttcaac

SEQ ID NO: 64741 - DNA, 881 bp, Homo sapiens
aggctagtacgaggctggtggtgcaatgccgttggcgggaatgtcggggcagggcgccagtccccgagggggtggccctctcatcctgctggatcttaatgatgagaacagcaaccagagtttccattcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagaggtaggaccaggtacctcccaggagctctctcctctaagtcctgtcttctccagagtctaacctaccagctcatccctatacctgctccccgtcttgtgcaccctcctcaaggcgccttccgactcctgcagaatctccctgtagctacagtctcattcctctggtctcttagaatctatacagacatatcactgtctgagattttcatgtaaattaattttttactagtttatctttctcctcactctcatgtcagtttcctgaatgttgggcccatattgatcct

SEQ ID NO: 64742 - DNA, 283 bp, Homo sapiens
ggatcccccagtggtggggccctccgagtctctgtgtccccaatgctgaccaaggaggagcctgttccagaactgctggaagctgaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaa

SEQ ID NO: 64743 - DNA, 1727 bp, Homo sapiens
acgagagagggcgcggccaactccaggtgggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgagactatggaaatgatgttagacaaaaagcaaattcaagcgattttcttattcgagttaaaaatgggtcataaagcagtggagacacttcgcaacatcaacaacacacttggcccaggaactgctaatgaacatatagtacagtggtggttcaagaagttttgcaaagaagacaagagccttgaagatgagaagcatagtgtctggccatcggaagttgacaatgaccaactgaaagctctcattgaagctgatcctgttaaaactacacaagaagttgcccaagaactcaaccatcgaccattctatggccgtctggcatttgaagcaaattggaaaggtgaaaaagctcaataagtgggtgcctcatgaccttaccaaaaattaaaaaaatcgtcattttgaagtgtcatcttctcttattctatgcaacaacaacgaaccatttcttgatcagattgtgatgtgtgacaaaaagtcgattttatatgacaaccggcaacaaccagctctgtggctgtactgagaagcagctctaaagtacttcccaaagccaaccttgcaccaaaaaaaggtcacggtcactgtttggtggtctgctgctggtctgatccactgcaactttctgaatcccagtgaaaccattacatctgagaagtatgctcagcaaatcgatgagatgcaccaaaaactgcaaggcctgctgtggcactgctcaacagaaagggcccagttattctccatgacaacaaccacacatcgcataaccagcgcttcaaatattgaggccgggtgcggtggctcacgcctgtaatcccaacattttgggaggccaaggtggacggatcacttgaggtcaggagttcgagaacagcctggccaacatggtgaaacctgtctctactaaaaatacaaaaattagctgggtatggtagctggcgcctgtaatcccagctactcgagaggctgaggcaagagaactgcttgaacccggaaggtggaggttgcgatgagccaagattgtgccactgcactccagcctgggcgacagagtgagacttcatttc

SEQ ID NO: 64744 - DNA, 474 bp, Homo sapiens
aaaaagaaaacagcaaaataaagaaacacaacacagagtagacatatacaggaagagaccctcgacaaaaaagggcacagagcccagtcctgggggcaccccccagcccagccgccctgtgtcacctgccggacccccagaaggggtccctgaggaggctcagcccccacggctgggccaagagagaggtaggaccaggtacctcccaggagctctctcctctaagtcctgtcttctccagagtctaacctaccagctcatccctatacctgctccccgtcttgtgcaccctcctcaaggcgccttccgactcctgcagaatctccctgtagctacagtctcattcctctggtctcttagaatctatacagacatatcactgtctgagattttcatgtaaattaattttttactagtttatctttctcctcactctcatgtcagtttcctgaatgttgggcccatattgatcct

SEQ ID NO: 64745 - DNA, 947 bp, Homo sapiens
tcattttatttaagtaatgtacattttatttaagtcatgtgatggattttcacagaatacatatgcccagggaaccagcaccagattacacaacagaactggatcagctcccagaagctctcccctcgtcccctcccaaccctaagggcgatcactatcttgactttggtgcactataaattagttttgtctggttctgaacgtaatacacctggaaccatctagtatgtactgttgcatttggcttctgtcactcaagatttcatcatgcgacttgtctatgttgctgtgtgtagccgggcatgtcaatcccgttgctgtgtctatgtgcatggtagtgagtagggcatcattcattttccattctgttgatgggttatttccagtttggggctgttatgaaagggctctgaacattcccatgcaccctcttgatgctcacacctacacatttctgctgggtgttgacagcctaggagtggaactgctggatcacagaggtggcatatgttcggcttcattagaaaactgccagttttccaaaatgtctctaccaatttacactcccccagaaatacaagagaggtccagtcgctctactttctcgcctccacacggtgcggtctttttcactttagccattctggtggtggagacccactcgtattcgcagcgctttctgtcctcttgcatttgcctgtggatttgcagttggtaatggcgttcttgcccggccctcctttgttcctccaggcagccaggcagctgtggcgtagtgaaagggcaggatgcgggataggaatggagttattcctgattcagactgatttgctctaactgtgatttggggcaagtcccttcccctgtctagaccttagctggctgccgcatctaaaaaatggagccaataatcttttcctcgtctttggggtcatccatctttcaac

SEQ ID NO: 64746 - DNA, 776 bp, Homo sapiens
aggctagtacgaggctggtggtgcaatgccgttggcgggaatgtcggggcagggcgccagtccccgagggggtggccctctcatcctgctggatcttaatgatgagaacagcaaccagagtttccattcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgccctcatacctgctgtcagctactgagtacccccaatgttgcccaacgaggacccttgttcagaactgctgcacgctgcggccctggagcttaccctgcctttgtgcacggccctgttcctgtgtcgcccacgtcgctacagttcacttcattctgcccccccctccatgcgccc

SEQ ID NO: 64747 - DNA, 616 bp, Homo sapiens
atggaaagtcagatgtttccattaattttcactctgggattatagaaagaaaaaaaactcgtctgcttgtttattagcgcacttagctccaggctaaacatgtgcatgtttacaaatctgcacagaaagctcatttattgtaatctgggagactctcactcaagcaggccacgctcttgtcctttctcctgggaacctggttcctacagagatgtctgtctcttctgccttccttcagggataaatgcacgaacgcaaatatgcaggctctagctgaatacacaaggctctgaatacaaggtgtgtattcacacacctattcaggccccctttcaaagagccaccacctgtatcatgtgtgtgtgttagatttttttctgtctctcctcaccaaggtctcttagaatggggacttgtcatcagcacctcggagccgagcctggcccagagaggccccttataatgaacactgaatggatgaatgaagctccatttgtaatcagcatgaagccaaataagtcatcagaatggcgcatgcttcattaagactgtgatcatatggcattttcataaggaagttacaagtcttaaaaggaccacaagtgacaaaaaaaaa

SEQ ID NO: 64748 - DNA, 552 bp, Homo sapiens
ggactttgcactctaaatatagaccccagcttgggacaaaagttgcagtagaaaaatagacataggagaacacttaaataagtgatgcatgtagacacagaaggggtatttaaaagacagaaataatagaagtacagaagaacagaaaaaaaactcagcagatggagattaccattcccaatgcctgaacttcctcctgctattaagattgctagagaattgtgtcttaaacagttcatgaacccagaagaatgcaatttcaatgtatttagtacacacacagtatgtatataaacacaactcacagaatatattttccatacattgggtaggtatgcactttgtgtatatataataatgtattttccatgcagttttaaaatgtagatatattaatatctggatgcattttctgtgcactggttttatatgccttatggagtatatactcacatgtagctaaatagactcaggactgcacattccttgtgtaggttgtgtgtgtgtggtggttttatgcataaataaagttttacatgtggtgaatatacg

SEQ ID NO: 64749 - DNA, 570 bp, Homo sapiens
tttttattcgcagttgccaaaatctggagacgagcaaaatgtccttcaatgtgtgaatggttacacagatcacggtacatcagtgccatggaacactattcagcactaagaaggaaaaactcttgatgcacaagcagctcagaggaatctccagggaatatggctgagtgacggaagtcagtcctaagggttacatagtatatgattccatttatacaatatccttgaaataacaaaattttagagatagaggaagattggtgatttcctggctttaagaatcatgcgagttgcaggtggatgtgcctgtaaagatcttcatggtgacagaaccattctgtgtcttgtttacggtggagatcactcaagtctgcatgtgatacagtgacatagacctacacaaacattgcaagagtgtcagtttcctggtgtggatattgtaccatagttcataagctgcagccattgggggaagctaggtgaaaggttcaggagaccttcttgtactatttttgtaacttcttatagatctataattatttcaaaataaaaagttttaaaaaggaccta

SEQ ID NO: 64750 - DNA, 2020 bp, Homo sapiens
agcgctggcagcaggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgacattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaatca

SEQ ID NO: 64751 - DNA, 1633 bp, Homo sapiens
ggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgacattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaatca

SEQ ID NO: 64752 - DNA, 822 bp, Homo sapiens
gcatgagtctccggcagggctgtgaaggtttccgggaagccagccaatcattcccaacggaaactcagtagcggcattttcaactggataaactggccttagtcccgccttctcgttccagagttttgtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttgtgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagagga

SEQ ID NO: 64753 - DNA, 388 bp, Homo sapiens
aaggcgggattagcgtttgctctcaaaataggtacatcgacaaaagtgtccattctcattcttctaaagttgtatcaaacattgaaagtataaagagaatacctgaaactcatcatgacattctaactagtatttaacaggttaaggcagaatactttcttattaatttaccaataatagacaatttggtgtcaaaatgaaatgcccacaaataacataaggtatttagtaagtaataaaatctacttaactgtgggagctatgcaattcatgaagagctacatggtactagcaggtgagtaagttggcttccacacctcaaacattcattttgaactaataaagagcatattaacttgatttttagcattaaaaatactgaatgtta

SEQ ID NO: 64754 - DNA, 506 bp, Homo sapiens
ctgtaatcccagcactttgaaaggctgaggcaggcagatggcttgagccaagagtttgagaccaacctgggcaacatggtgaaaccctgtctctactaaaaatacaaaaattatctgggcggggtggtgtgcacctatagtcccagctacttgggagactgagggtggggaagatcacttgagccccaggatatcgagggctgcagtgagctttgatcatgcccccacccactacagtctaaatgacaagagggagatcctgcctacaaaagaaaaaggggaaaaaaaaagaaatatgttcttcttcatatatgtgctgcattttcccaagaaattagtattgacagtgtagacataatattccagaaatagtttataagccactgtagaaaatttttcagatttttctccagttactcttctttttgaccaaatatagcatgatccattgagccacatatttttatcatcagatttcctgcaaatcccttttgcctatttcttta

SEQ ID NO: 64755 - DNA, 338 bp, Homo sapiens
ctgctatagaatgtttcctggagaaaggtacggtttttagtaataagataaatttactttagtcctgcaaataaggtgaaatcttatgtccagtatctcacaaaggagaactgacagtgccacttttatatttaatgtcaatctcattagacaaaaatgaaatatagttcctagggtttccaatttaaaaagtgaaataataaatatattcactcaaacattttctcagtgccatatgcaagttaccatgtcccagaagctgatacagtttgaagaaggaaatatataagtactgtaagcctgtgataactaaaagcaacatactaaaaagtgaaggt

SEQ ID NO: 64756 - DNA, 1194 bp, Homo sapiens
  misc_feature (176)..(176): n is a, c, g, or t
  misc_feature (1187)..(1194): n is a, c, g, or t
agacaatttcctcaatcgtcctggctcaaaatgagccaagaattcaagcagacaatctactcaaaaggaatccatttcctctcttggccacacatcagttgtctgaaaacagttggcctgtggcgatgcctcactccaactgccacactgatccacacatcttgtgtccaaagcanaacacaagtgtccatgggaggttgcacaacacagagccaagagatgcctgtgtcctccactgagcattccacaggggaaggggcctggtaaaaggaaaaggatggaggcagtgtttgttgagcgctgtggtgggtgtgaacccacaagcccgcaggggaaccagaactctcatgggctccttcagggctggggtggggcctcttagaggtcccagggcctgtgcacgggcccccatggcatagggacaggaggcagccctcctctcctcttggcatagttcctccccccgtcaatgttcacatcaccaaacacattctgtctaaggtggggtcatcaggaccacaggcactggttgctctgggaactactgcctcatagcattttattttgctcatgactcaagataatcaggattttaggaaagacccagctaggaaggtcccaggaggtgcaggccgggagtggctgggaccaccatcatctacaccatgactgggctccctgataatgaggagggggttttataatggatttattcagaggtaattcacacactgtaggattcacccatttaagcatacaagtcaatgactttagtatattcatagaattttatatccaaaccacaatcaattttacaacatttttgttaccctaaaaagaaacctcaaactttttagcctttatatgccaatttctccatcccctttcagccctagggaggagccactaacgtgctttctccacagatgtccctcttctgggcattgcacgtaaacggaatcgctgtgtgtgatctcctgtgtctggttcctctcacttagcatgttcccaaggttcctcctgtctgtagcctgtatcactacttcatttatttttattacaaataataacctgttgtatgcatataccatattttatttatccactcattaattaatgagaagtagggttattttggctactgttttggctttttggctgtttttaataaatactgttacgatcannnnnnnn

SEQ ID NO: 64757 - DNA, 413 bp, Homo sapiens
  misc_feature (362)..(362): n is a, c, g, or t
ctgctccttatgtttttatttccaaagtttagaatttctttgcttcatagtattattttattttactaaattacagagtaagaaaagcttttcattttatctgattttattcttagaacaaaaatattacgatcttctatatttttgttcttttgccaaaaagtgtaggcaattttacatcatcttttttcccaatcagtttgtgatccaactataaaaaggagacatagaatactgaataaatgaaacagaaactccaaggccaagaagtgtccatcttgaaagagtgttagtggcaagatatgtgactgcagactagatgtagacaaacctgagaaaaaccaagcatgggggaaaggatncctattttaataaatggtgctggggaaaactggctagccatatgtacttta

SEQ ID NO: 64758 - DNA, 318 bp, Homo sapiens
aatacctccctcttgtcaaccacatgtaatccattagaaagtttcattgggtctgtctctcaaatatgcctagaaactgctcatttctctccagttccatgactactgactctgaatcattccccttcacttgatctattaaaatagccttttaatgggctgtctgctttcactctcactgcccctccaatctgtgcctcacactaccctccgagtgatcactgtatgtatatttcccctagacatatgctttaaccctggcttcagccctgtaggaactggctgctctttacctctccttccaatctcatctgaagg

SEQ ID NO: 64759 - DNA, 445 bp, Homo sapiens
gcttccacaacatttttacttaggctacctcattggatcataacatcaacttggtgagaaaggcaggacagatattttatcctgtgaataagattttagctcaaatgggctacaacaagactaagataggagagtggcaaaatcatagtagtccagtgatgttcttatatcaatcaattatcattcaataaatgcttattattgttgtaggctagtcactgtgctaaatattgtaactgaattaccttattgaactcttacaacaatctcatgatatagtactattattattattgtacccatttatggataaactgaggcacagtgaagttagccacacagctagtaagggccagcactgggattttgggtcaggcagtgtgagttcacagccaaagctctcaatgtggcctaactactgctctatatttttagggtgtccttt

SEQ ID NO: 64760 - DNA, 463 bp, Homo sapiens
tgttaagcaaaaaatgtactggaaagatattcttactttccatcagtctatttattataggaaagggaggttgagatcgatcctttaactgtagtgaaagctatagttcttgaaattaagagtaattttataataaaagtgtaaatgttaataattggctccctgtatttagggatgctttttttaatggcctaaataagaattagtgtattgctacaccagtgccacaacagctgatgtttggttatggtttagtgaggatttttgtggttttgaggagatgtcacatgtaaatttgacatacatattgcaaaattttaaaagctgacttgttgcaatgttttaaaattatatttaaaaattatagaaaaagtttcaggaatttcacagttagacatttctttgctggggtttttgtttagcgagaggctaattttaggtgtttttaaaagatacaaactaa

SEQ ID NO: 64761 - DNA, 214 bp, Homo sapiens
gaaaatattaaatattttatatccagggtgacttcccacctccccttttgtctagaaatgcattcctcttgagggaatcccctaggagcaaagcaaagaaggctgtggcttatgtgtgtaatcccagcactttgggaggccaaggcaggaggatcactggagcccaggagtttaagcaccaatctgggcaacataacaagacctcctctctaca

SEQ ID NO: 64762 - DNA, 572 bp, Homo sapiens
gttttaagaacattttcgcaaagaggaaatgacagctctccagcgtataggatattcaataaaggatgtaagagaactgtttatccatttgaaaattaaagttatatatccatgtcataccacatgcaaaacacagctgccagctaaatatttaatgtttaaagtattttaaaaatcaagaaaatataagcaagtatttatataacctaggggatgaaaacctttctaagcatgacaccaaggaagaaaccaaagataagaagatggatttggcaataaaaagaaaacttagaggtggcaaaaacactaagcagtaaaatgagaaaatacatttgcaacatactttctctttaatttgaagggctaattttctcaatataaagaatttttagaaattagtaagaaattccaacatccaacagaaatataggttaaggaaaaatataatttactaaaggaatgtatcgctaaatacatttaaaaagctcagcagtaataacacaaatgatactgattttttacctattattaaaaatactgcaacttatggtgtcaacattgtcatattaaaa

SEQ ID NO: 64763 - DNA, 344 bp, Homo sapiens
atatgatttttgaaacagttgatttaggtaacactccagtcatgaataaggagtctcgtaagttgaagagggctagataaatatggttagtgcaagagatattcttattccggagaggttatttggggatgaggttcagaattcctctcaggctttcagtggttaaataaaagaagattttggctctcggtggccaaccttccagcacatttgggcttctagaacaacttctccattcctaggaggagcggagtaccctgtggttttaccctctcatgcactcatttacttgtcattgcaatcctgagaaatagacaatattcatattgtacctaagacactaa

SEQ ID NO: 64764 - DNA, 2182 bp, Homo sapiens
  misc_feature (331)..(331): n is a, c, g, or t
  misc_feature (347)..(347): n is a, c, g, or t
  misc_feature (406)..(406): n is a, c, g, or t
  misc_feature (517)..(517): n is a, c, g, or t
  misc_feature (638)..(638): n is a, c, g, or t
  misc_feature (839)..(839): n is a, c, g, or t
  misc_feature (997)..(997): n is a, c, g, or t
  misc_feature (1081)..(1081): n is a, c, g, or t
  misc_feature (1368)..(1368): n is a, c, g, or t
  misc_feature (1703)..(1703): n is a, c, g, or t
tgagaaaaattctcgctctgtcacccaggctggagtgcaatgacacaatctcggctcactgcaacctccgcctcctgggttcaagtgattctcctgcctcagcctcccaagtagctggaattacaggcacccgccaccttgcctggctaatttttttgtacttttagtagagacgaggtttcaccatgttggccaggctggtcttgaactcctcacctcaggtgatctgcccgccttggcctcctcaagtgctaggattacaggtgtgagccaccatgcccagccaaaagtattatttaaaaaagtttttcttacttgtattttaggttcngggatacatgtgtacnttagttatatatttgcctgtcacaggggtttggtgtacagataattttgtcacctgggnaataagcatagtacccaatagataattttctgatcctctccctcctcccgctctccaccctcaagcaggccttggtgtctgctgttcccctcctagtttccatgtgttctngttgttaagctgtcacttctgagtaagaatatgtggtatttgtttttctgttcctgtgttagtttgcttaggatcatggcctccaactttgtccatgttgctgggaaagacatgatcttgntcctttatatggctgcatagtattccattgtgtatatgtaccacattttctttatccagtctaccattgatgggcattaggttgattccatgtctgtgctgttctgaatagtagaacaccattcatcccctcactgttagttgaacatctgcaaaatgctgggtaatgtggggtgctgaaacacaaagatgaaagagacangagcagtacctttgaataatctataacctggttatctctacgatgattttggcaagaacgtgcagatgcatacacatatacacaaaatgctgcacatctttcagcatcatacaaattttgtagaagaatggccaatccctaaattagatcagtgcaanccaaatgccttctcttcccactttaatgtttgaaagatacatcattcagtttttgattctgaagatttaatatgcaccagcttntgtttctggttaagtgattttcattatcctcgaaggctagtcaaataacaaagcaatttagtaatggcaaaagcataaagtgtggaccagaggggtcttcaaaatattagggaagatagagcagaaaaccatttttttcagtttgttgttataaaattatacacacactctgagtcaccaaacacattggaggttgataaggaacataggagtagtcacgggtcctaattctgcagtacgtggctatgcgggtatgaactcttcataaatacaatgtgatgatgacnttgcatttgcatttctcttcctcctttctctcactcccagtcttagatacccgattgttccataaatcttgtcttaagagaaaggcatatcctataaactcattcatgtgaaggtatttgcattagcagtgttggtcttggatcactttgcaaacaacccttccctgaaaatgagaagtccaatcaaggagcttcctgaagtataaaacttttttaactaagtaataacatttaggtgcattcatcctcatgattttttaatgtaaatactggctctgacacagtgccacattcttagatattaggctaattgtgctttgctgtgccagtctctnggtgaatgtaatgtttaattacatttccagaagaaagctgagttctattttatgattaggagttttatttgatgtctgaaatataattggaaatacttgcagataccctatctgtgtttgaagtggcactcaatcatccataagaaataccatatgtccatttcaaatattaggtgttttacatgaaggaatacatgatgataacaatatttcttcaacatatcttcattttacctaagtgcgtaggagagctcttttagtaattacaaagtaaggtgaaaatagtcatccctactgggtagagaccttttattttaaaagggggagtggctaagctcagagataagatggagccacatatgaacaatatgctcatagataaagctatgaatttgatggaaaatatgaacaatatagtgttaagtgaaaatagacaaaatgatatatgtaacttaatgtcaattttatgaaaaaaaaaa

SEQ ID NO: 64765 - DNA, 559 bp, Homo sapiens
gggggaggagtgatcatggctacctcagagctgagctgcgaggtgtcggaggagaactgtgagcgccgggaggccttctgggcagaatggaaggatctgacactgtccacacggcccgaggagggcaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcccttcgtcgctccctgtcccgctccatgtcccaggaagcacagagaggctgagagggactgtgacttgggctccgctgtgcccgccctgggctgggcccttcctggctaggactgtggaggggagctgctggccatggctgctttgtagtttgcccagagttgggggctaggggaggggggagccagaggccaggatgcctgagccccctgagttcccaaagggagggtggcagagacagtggcaccctctgttagtgccgcaataaatgctcaatcatgtgccaga

SEQ ID NO: 64766 - DNA, 793 bp, Homo sapiens
gggggaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccaccaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcccttcgtcgctccctgtcccgctccatgtcccaggaagcacagagaggctgagagggactgtgacttgggctccgctgtgcccgccctgggctgggcccttcctgctgaggaccctcagccccaggagaagggacaaaaggtactggtgagggcaagaggtgcctgggaggagtggccctgatccaggaaaatgtgaggggaatctggaacgctctaggcagaagaagctgggagggagggggaggtgaaaagggcagaggcaaggatggtggggcccccagcaccctctgttagtgccgcaataaatgctcaatcatgtgccaga

SEQ ID NO: 64767 - DNA, 964 bp, Homo sapiens
gggggaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccaccaaggaggagcgtgaggacacccccatccagcttcaggagctgctggcgctggagacagccctgggtggccagtgtgtggaccgccaggaggtggctgagatcacaaagcagctgccccctgtggtgcctgtcagcaagcccggtgcccttcgtcgctccctgtcccgctccatgtcccaggaagcacagagaggctgagagggactgtgacttgggctccgctgtgcccgccctgggctgggcccttcctggctaggactgtggaggggagctgctggccatggctgctttgtagtttgcccagagttgggggctaggggaggggggagccagaggccaggatgcctgagccccctgagttcccaaagggagggtggcagagacagtgggcactaagggtggagagttgggggccagcacagctgaggaccctcagccccaggagaagggacaaaaggtactggtgagggcaagaggtgcctgggaggagtggccctgatccaggaaaatgtgaggggaatctggaacgctctaggcagaagaagctgggagggagggggaggtgaaaagggcagaggcaaggatggtggggcccccagcaccctctgttagtgccgcaataaatgctcaatcatgtgccaga

SEQ ID NO: 64768 - DNA, 681 bp, Homo sapiens
gggggaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagcaggggcagtgccaggtgctggtgcagcgctcgccctggctgatgatgcggatgggcatcctcggccgtgggctgcaggagtaccagctgccctaccagcgggtactgccgctgcccatcttcacccctgccaagatgggcgccacggagggggaggtgaaaagggcagaggcaaggatggtggggcccccagcaccctctgttagtgccgcaataaatgctcaatcatgtgccagagaaaacaaaatgacgagtccctacgacgaaaaaacactacgttggttggggcacgctaggagcacctcagaaaaagcgtttgttaaaacccagttcggtgggggcagagcgcgccccgtacggcacaggtgaacatggggcataacggccccaagaagaacggggccagaaaaaggcggggctccacccaaaaaaacgccggcgtaaccggcgtgggacaacccaaaggagaggcgaggcaggggtcatcaaggagcaaggacgataatg

SEQ ID NO: 64769 - DNA, 353 bp, Homo sapiens
  misc_feature (330)..(330): n is a, c, g, or t
  misc_feature (340)..(340): n is a, c, g, or t
caatacctccaatcaaaaatcttacccaggttatgctatgaaacaaaaacttgctttagaaatcaatacagaagagtccagaaggcttgtttaatgcttctaagacttttcagtgggttagtctaaatgataagtgtatttttaaaatttttaataaaaatgtataatttttaagtaaacctttctgttaacagtcttgattagaggattttaattatgcttagagataatacatctgtatcttctgtggaatttggtgttgattgcacctatgatttgctgctaccatcttgtgtggaaggaggtgtctttgggccatggatgggaggngagtccgggnaggctgagctact

SEQ ID NO: 64770 - DNA, 493 bp, Homo sapiens
gccagagccacccagctggcctcggggatgcaggcggtatgtgttctgggctctcacgaagctaagaaactctaaatccaaggtgacatcgtggcacaccgccacctgcttcagggggacacaggggacaaggaggagctattggcagagcgctcggttcctgcaagttccaacttctgctaaaattggttaattggttcctttgcatgattcagggcacacaggcttctctgtccacaaaatttgctcgcctgcacacccagagaaatggacttggcttggtttttctgaacttttgcctctgcggaatcagcagtggacgtgtgagctggggcctctgtccctgtcatgtgaggaggtcaggcaggacaagcaggaagcactgggcaatgagtcaggaggcctggtggggagcttgggtgagtctgttttcctctctggacctcagtcttctcctctggttgatgtaataaaatcctacaaactgaaaatt

SEQ ID NO: 64771 - DNA, 153 bp, Homo sapiens
tagacggagtctcactctgttgtccaggctggagtgcagtggcacaatctcagctcgctgcaacactctgagcaaagaataagtaataaggttagaattctttagaagtgttaaggggaaagaaggtaacaacaacaaaaactcctccacatc

SEQ ID NO: 64772 - DNA, 735 bp, Homo sapiens
tggtatttactgtttcccaagtataagacctattaatattccatagaacaacttctgatgtttcagacttgactctgaaaataatctgagtatggactgcactgtgctattcctgtgcaacaattaccacagagtgaaacctttactgctttttctcaaggttcagacctgtggtacattattctaaaggtatagacaagaaacagttccaaggaggataagactaaatctctgaatattagacctgacagaggccttaggagttatcatctctttccattaacatatgaagaagctagagtctacagggattgagaactggctccaagatcataagatcttagaaagtggctgtcctgctgccctctcattaccagacttgacaatggtgcctcagcaggatggcatttcagaggcaacccatcttgcacaacctggaattctctggaggtctagtccagggccaccaggtggaaggctaaggaggaacagctatgagcactgcaggagaccgcctcaggatactcttgttctctcctcttgctttgctgtttttgttctccaaatgaccatcatcgtcagaagacaattttgaccacgaaatgtttgtagtgagaatatcaggcaggtgtctgatattccatggtttacagtttattccaggcaggtttatgtttccttgctaatacacgtacaattttacaactactgtattaacaggcatttacaacaaac

SEQ ID NO: 64773 - DNA, 868 bp, Homo sapiens
gtcatccttccagggtgagggaagcggattttcccgtattttcatttcagctgttcctgggcatcctgaactttgcactccagtctgagggctccaaagaatggctgccatggcaaccgtttccatgtttttgtcaccaagggactcaacactcagtgtgaactctgggtggggggagccctccagcccagagaagtggctgggccgagtgtatttgactgtgcagacagaggtcaccgtggcaactgagtgccccttagctaagcaatgggggagccacccccagcatccctgagagccccgctttcctctccccaggactgagctgaatacgaatgagctcgggatatggctgtttctgccgtgctggacacctcggaccccttgtacagctgtggtgtccccagccagcatgggctggagcagcccaacaaggatgctgcagaaggcaccctgggctggggctccaggagagctcagctttgatcccaggctccgagcatctgttggtgctgtgtgctgaatggtgtcccaacaaattcctctgttgaaaccttacaccttaaccccctggacttcacagggtgactttacttggagatagggtctttaaagtataattaactacccattaaaatttttaaaaatgttaagtataattaagatgaggtcattagggtgggccctatgacctgtgtccttgtaagaggagatgaggacacagacacacagagggaagaccctgtaaggacacgagaaggtggccatctacaagccaggagaggacttggaggaaagcaaccctaccgacaccttgatcttggacttccagactccagagctgtgagaaatacatttctgtggtttc

SEQ ID NO: 64774 - DNA, 240 bp, Homo sapiens
ttttgccaagtatatgtagtgcaaatattttctttcagtctgtagcttgcctttttattttcttaatgggtatctttcaaaaaaatggaagttttaagtttgaatggaattcagtttgtcttttaaagcttgtgctttttgtgttcaactaagggatattagcttaccattttttttggttgaatattatgtgtttatagacaagaaatggtcactaaagcaaaataactgaaaattatc

SEQ ID NO: 64775 - DNA, 556 bp, Homo sapiens
actttataaaaacggagacgtgacggtggggacgtgaccacagcactaatctcaccacacatcacaccatcagaagcgtccagtccagaataatgggacagcctacgaagatacatctgctgggccagctcagaggttctggctcacgggatgatgaagatatgaaaatttgactatggcactgacaagcccagatggcacctccaggagctccccatgccctcctctgaggtgaagtgttcagaggctggacgattttctacttatctttgtatcttcagaatcccaccccaggctcagcatgcagtagttgttggaaaagtctctgtggatatgcaagctcctgggaaggtttgactgctgtaatttctgcagcatattcactgtccacccaagggacacatccatgggcctgctctcagtgactgtgacttcttccacatctaggaacctctcttcaactccttcctgtgcccagattcacattattcacttaagtaaatcaaagctgatttaaatggatgttttcaagaacttggatgttttgtggccactg

SEQ ID NO: 64776 - DNA, 401 bp, Homo sapiens
tataaatacactaacttttatctattatttatctgaagttcaaatttaactgtgtcttttgttatctctcaactccgatgcatgggaaccttggtgttcttctgtccaagcttagctccaactacctccagagacccattggagaaagacaccagtttttgagccaactactacaattcttataatgtggataccattgtgtcttaaagtcagtttttttcttattattcttgtgtccaaaatgacggtaaaacacaaacaatatgactgtgctgatacgtgttggtggcacctattaattatttggttctggcactgaagataaatatgtgtatttatgagattaatcttttagctcgagaataacaaccacttaataaaatatacaattttgcttttat

SEQ ID NO: 64777 - DNA, 356 bp, Homo sapiens
atttatagaagggattttattttacatatatatatatatatatatatatatatatatttgtgtccatatatatatacatgtttatctcatagaatcttatctggtagataagaaaaagttaggtccctttcctacaaatatatttctatcagcattgtttctagttctataacactagaaatagcataaatatctgataattaagagattttaaaaaatgtattcttacattcaatcagatttatttaccttcctagtgcatactaggtactagccaggtacagaggacacaaaaatgaataaaatagaccatatctctatgtgttagcaatttagaacaggggaactagtcatgg

SEQ ID NO: 64778 - DNA, 329 bp, Homo sapiens
cagagtgaaacctcatctaaaaaataaagcaaacatgtttataatagctgtctttataatggtgacagtgtggaaaaacccaggtgacaatatggaaagagtaaattatgacattaacatgttgagatgctacgtaattattaatattagaaaagacctatcaaccgacgggtgcggtggctcacacctgtaatcccagactttgggaggcggaggcaggtggatcacctgaggtcaggagtttgagaccagcctgcccaacatggtaaaaccctctctactaaaaatacaaaatttatctgggcttggtggtgggcacttgtaatccc

SEQ ID NO: 64779 - DNA, 581 bp, Homo sapiens
tccctgaaagaagacattggtgattccccaggtctcctacaactctgaaattttgattccaggcaatccatggggcagactttttatccttatttgacagatagagaagatgtcatggccctgtaagtcaagagaacaggatggccaaaggcaagaagaaaaagacactggaaggggcccctttctccttcagagagcctcgttcttacacaagggccaagaaacaggacatctaaggacttggaagccccaggcacgtgacccccggcctctctgttctccagctaaggaacgctttatggccttcgcatttattcatgtatttcctggacctactttgtactaggccaagggaagtgagctgaataagacccagcggggttgagagacataaaaatggcttattgaaattcaatactccaagggctggaagagatggatgagtagcgagccggaggagcacaaaggcaggagtcccgctgtctgcctagggaatgcttgaggaaataagaatagcccacatttattaagcacacagtacaagcaagcactctattaaatgccttacatgatgtaaaaaa

SEQ ID NO: 64780 - DNA, 409 bp, Homo sapiens
  misc_feature (8)..(8): n is a, c, g, or t
  misc_feature (21)..(21): n is a, c, g, or t
  misc_feature (38)..(38): n is a, c, g, or t
aaccccgntggcggcccgccnctaggaaacctaggggnatcccccccgggcttgccaggaaattcggccacggagcatatcattcactctctttctatctgctttatcaaccaagctgacactttgccttttatcataccaaagaagatacatttcacttgtacatgatttacacattctgcctacaaatgagaggatatgaaaaacaagatcatgcacccctgttcttcacaaaacatatttaaattatatcattggttttgaattgtctcctaattttttagatctttgcattttttatgttcttaggaataaatggctatgggtcaattttaggatttactgctttccagaagtaatccacaaccatttattgcaaataaaggaaagtaaaaaatacaaaaataca

SEQ ID NO: 64781 - DNA, 155 bp, Homo sapiens
ggaaaacactggtagatctgagtgtgtaaagattttaacttctgctcatgaaaatatagcaaaagcaaaatttaaaggcaaacaaactaggaaaatatcagagaggttttatacacttaatatataaaacattcatgtaggctgataagaaaaac

SEQ ID NO: 64782 - DNA, 348 bp, Homo sapiens
cccattcccactcccatctcccctccctacagtccctggcatccattaatccaccttctatcactacagatttgcctgtcctgaacatctcacagaaatggaatcacacatgtggcctcctgcacctggcttccttgatgcagcctcatgttttctagatttttccatgctgtagtctcagggcttcactccttcctgcggctgattaatggagacttgtttatgtcatgcacacaccttcacatgcgtccactcacactcacaagtcatcaaagagctcaagcagcaggcaaggctcaggagaggcactctgagggacaggatgatgggcccggctgtttccaaaac

SEQ ID NO: 64783 - DNA, 303 bp, Homo sapiens
tctaagagagggtaaagtctgaggtgaccttattttaggaatttcaataggtgaagatctgtcttcatcttgaaacaagacagcaaagtcttcatcttcaaacaggcctgaagttaattcgctttgaggtgggataaagcaaccagaatttttataagatgaagaaaatccagctttatggaggaatgggaaagttccactttgagagggatgctgtggaatcatgattggagaatgacctgtgctgtaactttcaggacgaggatgaaggaaatcttttaaatctttacataattggcccct

SEQ ID NO: 64784 - DNA, 1932 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggagggtggaggtccggtgagctgagattgcaccactgcactccagcctgggggaccgagttagactctgtctcaaaaacaactaacaataaaacctacattacaaactaaaaactttaaacacaaaaacaaacacgccgcaggcaccaatgccagagagcgaaaacgacgcacacgaaagtggccaagtgcaataacggttacgaaccaggtttcttgtccccgtggataactggcggacccataaagaccgaaataatccggaaagccggggccgtagccgaccgtggcgcgacggaggagcaacacagcagagcgcacggacaaacgagaaggaagagagacagagagccagcacaacaacggcagacaggcggaagcgaacgacagatacagcagacacaaccgacaggcaaagagaacgaacagctgcagaacagcacgaacaagcgaggcgcacgcagcaccgacggagcagacaagctagcacgcacgacc

SEQ ID NO: 64785 - DNA, 2329 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagcttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 64786 - DNA, 1601 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgggaaaaaaaaacttttgttgggaacccaaaaaaaccttcggatttttttaaaaccactgggttaaaaaaatccgggcctttttgggaaaagaaaaatcccacgtgggaattctc

SEQ ID NO: 64787 - DNA, 2395 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacggggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 64788 - DNA, 2434 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 64789 - DNA, 2232 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 64790 - DNA, 2380 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccacatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 64791 - DNA, 1087 bp, Homo sapiens
tggtgttgggttcagaattttattttttgtttacaccattatatccgatcatatataaatacaaacaaaaacttcaccaaatattactttctttttctaatggtgtgtgtgttttggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctcccttgctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccgcgcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcccaatttttttatttaggggg

SEQ ID NO: 64792 - DNA, 1609 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctggtaggttgtccccactcacctcagtcatgcaggtgcgggccgggcaggtgggaagggccgggtgactcagcctggccctcaccctctgccgccacctcagtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64793 - DNA, 648 bp, Homo sapiens
  misc_feature (23)..(23): n is a, c, g, or t
ttcatgtgtctgtccccgggtantgatatgtcgaccagcctcgccacgcgtcggcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64794 - DNA, 486 bp, Homo sapiens
ctgcagtgagtagggttgttacattttacagatgaggaaactgaggcaaaatgtcttgttagggtcacacaggctgtgagtgagccatgccccagctctccagccccttggccaggacaaggagcctggagtctgggtctgggggtggcccctgagggtgggctgagtgggcagctgcagccctgctccctcctccctcccaccagctggtgggccagccggccgtacacttgaagcgtgacttcttcctggccaatgcgtctcgggcgcgctcagagcagttcatcaacctgcgagaggtcagcacccggggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64795 - DNA, 3642 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64796 - DNA, 2931 bp, Homo sapiens
gcgcaatattagatcgtgaccacgcgtcgagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64797 - DNA, 3411 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64798 - DNA, 2919 bp, Homo sapiens
tgctaagtacgaggccgcgtgttaaatcggccgaggcaaacaccctcccgcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64799 - DNA, 3674 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgaaaaaaactcgtgccgaattcgatacaagctta

SEQ ID NO: 64800 - DNA, 4141 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgaaaaaaaaaaaaaaaaaaaaaaaaaaaaaaaaaagaaagaagaaagctccgaggcacgatataattattcgggggttccggacaaagcaggttatttaaacacgggaacatttcgctaataagtggaggttgaggaaccgacatatttgttgataaacggggggaataaacttggggcgtgtacacactatagtagtgaagattaaatatataatcagccaaaccgacgggtaaaaccgcccgcaacacgagaccccgcaacacaacaaaggaagcaaacaaacacgcacacgagaagacagagaaaaagacgacaagaacgaacacaagaagcaagccaagaaaggagagaagaacaacaagaaacgacaaaacacgaacaagaaagaaggaccgcagagagagacagagacgagagcaaaacgagagaaagacagagaacacagaaacgcagacacgacagaaaaccgcacagagcacagaaagcgaaaacaacaaac

SEQ ID NO: 64801 - DNA, 3763 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaaagtgagtagcggctgagggggcaactccagcttccagctccccctaggggtgggggctcatgactgtcttctcagagggtcctgcttgatgccagagtgctgacctggagctgcccacagggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64802 - DNA, 3161 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaaagtgagtagcggctgagggggcaactccagcttccagctccccctaggggtgggggctcatgactgtcttctcagagggtcctgcttgatgccagagtgctgacctggagctgcccacagggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64803 - DNA, 2411 bp, Homo sapiens
ggtccgttgggaatagaaccctcggcttgaccccaaattccaagggacccggggacaagctaaggtggtttcagatgacaacatctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64804 - DNA, 2663 bp, Homo sapiens
atacatgtatctagaggtacacatgcatctagtatgtatctagtatatgtgatttagtatacatgcatctactatgtatctggtatacctgacctagtatacatctagtatgtatctaatttacatgatttagtctatgtgtatctagtatgtatctgggatgtagaatcctgcatctaggaaggtaggggtaaggatggagctcaggtccgggggattccaaagcaggtactcaccgtgcccctcccccacagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64805 - DNA, 2643 bp, Homo sapiens
ctgcagtgagtagggttgttacattttacagatgaggaaactgaggcaaaatgtcttgttagggtcacacaggctgtgagtgagccatgccccagctctccagccccttggccaggacaaggagcctggagtctgggtctgggggtggcccctgagggtgggctgagtgggcagctgcagccctgctccctcctccctcccaccagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64806 - DNA, 2105 bp, Homo sapiens
cagactggccctgatgagaccaccccctagaagcggaaccttggcgcttgaccttgaggaggccacctgggctgggccgggggaagacaggccagggtagacaggccccagggacagaggccaggcaggtcagtgcccaccagccctggcagagccctgctcctcacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64807 - DNA, 3025 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64808 - DNA, 1718 bp, Homo sapiens
ctgcagtgagtagggttgttacattttacagatgaggaaactgaggcaaaatgtcttgttagggtcacacaggctgtgagtgagccatgccccagctctccagccccttggccaggacaaggagcctggagtctgggtctgggggtggcccctgagggtgggctgagtgggcagctgcagccctgctccctcctccctcccaccagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64809 - DNA, 1166 bp, Homo sapiens
gggcgttctagaggatcccaatcagtttacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64810 - DNA, 1107 bp, Homo sapiens
ttctagaggatccaattcaacatgaagcacatagatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64811 - DNA, 1075 bp, Homo sapiens
gctcgctgattctagaggatccctaatccggatacggttctacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64812 - DNA, 972 bp, Homo sapiens
agtcgctctggtgagcgcgacgtaatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64813 - DNA, 1774 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgcatctgtctgtgatgtgtttctccccagcctactgc

SEQ ID NO: 64814 - DNA, 1805 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtactgccctgggtggggccttccctgaagggcggttcctgccccctggcctgtccttgcctctctggcacctgaccagggctgtggaaggtgctggctcctcctttcccctcctgcagctcgcccctgagttagcagctcgcgccctgagttagcagctcgccctgagttagcagctcgccctg

SEQ ID NO: 64815 - DNA, 1529 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcacttcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64816 - DNA, 2354 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaaagtgagtagcggctgagggggcaactccagcttccagctccccctaggggtgggggctcatgactgtcttctcagagggtcctgcttgatgccagagtgctgacctggagctgcccacagggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtactgccctgggtggggccttccctgaagggcggttcctgccccctggcctgtccttgcctctctggcacctgaccagggctgtggaaggtgctggctcctcctttcccctcctgcagcaccttatctctcttctggggacacccatctgagatgcctatcatgtcctgccctgactgactgtagttcatgtgtgcagctgcctgcctgggctgtgaattccaagaggacaggcttcatctgggtgctgagcagggcttggagaggatgagggtatgggaggcggagtgttaaagtgcgtgcatgggccaggtgcactggctcacacctgtaatcccaacactttgggaggctgaggtgggcagatcacctgaggtcaggagttcgagaccagcctggccaacatggtgaaactctgtctctactaaaaatacaaaaactacctgggtgtggtggcaggtgcctgtaattccagctatttgggaggctgaggcaagagaattgaattgcttgaacccaggaggcggaggttgcagtgagctgagatcgcaccactgcactccagcctgggtgacagagcaagactctgtctcaaaaaagaaaaaaaaaaaaa

SEQ ID NO: 64817 - DNA, 1390 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64818 - DNA, 1078 bp, Homo sapiens
  misc_feature (45)..(45): n is a, c, g, or t
gaccgacgctctctctggggggcgtgcgcagcatggtgaactcanggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64819 - DNA, 1473 bp, Homo sapiens
  misc_feature (59)..(59): n is a, c, g, or t
  misc_feature (81)..(81): n is a, c, g, or t
  misc_feature (1389)..(1389): n is a, c, g, or t
  misc_feature (1403)..(1403): n is a, c, g, or t
  misc_feature (1427)..(1427): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaaggttaaaatggcaagcttacnaaggccctgttcangggggggcaaccacctccaaaaangggctttttgaaaggaacttccccaagggcggggggtttacccgaa

SEQ ID NO: 64820 - DNA, 1471 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaagtgagggaggcgatggccgccaagagccagcagtcccccagtgctccctggcagtgtctgtgcgggtagctccatccacaataaactggtgcggcagagggagt

SEQ ID NO: 64821 - DNA, 1033 bp, Homo sapiens
gctcgctgattctagaggatccctaatccggatacggttctacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64822 - DNA, 922 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaaaggcactaggcttggggtggggaggtcccgtgttccatatagaggaaccccaaataataaaaggccccacatctgtctgtga

SEQ ID NO: 64823 - DNA, 907 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctactaccatgatcaccacacaggattctttcataagatcctgtagagtcaccttcagca

SEQ ID NO: 64824 - DNA, 795 bp, Homo sapiens
agctcgatcctcactagtgcaggcctgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64825 - DNA, 749 bp, Homo sapiens
tcttagtacctacctagtggggagtgtgaccttgactgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64826 - DNA, 482 bp, Homo sapiens
  misc_feature (482)..(482): n is a, c, g, or t
cagctgacctgcctgttctcccgcagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacatatagctatgggggatcaactagagtcn

SEQ ID NO: 64827 - DNA, 3040 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64828 - DNA, 3472 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64829 - DNA, 2966 bp, Homo sapiens
ggatggataagcaggggcaggagagcagagcttgcaggcaggagcccaggttctagtcttgggaaggcctgggttctgagcaggcccatctgtccggcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64830 - DNA, 3666 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgatagcccgtgcgggggagagacgga

SEQ ID NO: 64831 - DNA, 3475 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64832 - DNA, 3503 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64833 - DNA, 2797 bp, Homo sapiens
ggatggataagcaggggcaggagagcagagcttgcaggcaggagcccaggttctagtcttgggaaggcctgggttctgagcaggcccatctgtccggcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64834 - DNA, 2434 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64835 - DNA, 2863 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64836 - DNA, 1509 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64837 - DNA, 2724 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggggacagccccgggtttccccagcatcctgatgtgtcccctctccccacttcagaggccacccactcagcaccaccggcctggccttgcctgcagactataaactataaccactagctcgacacagtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64838 - DNA, 2463 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacattgaagcgtgacttctttcccttgggccaaattgcggttcttcggggccgcgcttcaagagccaagttccattcaacccttgcgacaaaggctcagaacccgatttccgcttgcaaacccggggcgagactctcgtgcggtgcgcgcaccctcaccagcttccaagcccccacacaagggagggcgcgagcacatccggtaccatagacgcactactatcatccagcagcaaagacgatgctcggggaacttgtgaaaccctagaaatgacccagcaccaccgggccaaactccccccaatgtacaca

SEQ ID NO: 64839 - DNA, 2233 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtactgccctgggtggggccttccctgaagggcggttcctgccccctggcctgtccttgcctctctggcacctgaccagggctgtggaaggtgctggctcctcctttcccctcctgcagcaccttatctctcttctggggacacccatctgagatgcctatcatgtcctgccctgactgactgtagttcatgtgtgcagctgcctgcctgggctgtgaattccaagaggacaggcttcatctgggtgctgagcagggcttggagaggatgagggtatgggaggcggagtgttaaagtgcgtgcatgggccaggtgcactggctcacacctgtaatcccaacactttgggaggctgaggtgggcagatcacctgaggtcaggagttcgagaccagcctggccaacatggtgaaactctgtctctactaaaaatacaaaaactacctgggtgtggtggcaggtgcctgtaattccagctatttgggaggctgaggcaagagaattgaattgcttgaacccaggaggcggaggttgcagtgagctgagatcgcaccactgcactccagcctgggtgacagagcaagactctgtctcaaaaaagaaaaaaaaaaaaa

SEQ ID NO: 64840 - DNA, 1467 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64841 - DNA, 1174 bp, Homo sapiens
tagctgatggcctcgggtgtgctgacacttcccgcgcaccgcaggggggcaaccaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64842 - DNA, 1179 bp, Homo sapiens
tgatgagccggtcccatcgttagggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64843 - DNA, 1218 bp, Homo sapiens
  misc_feature (1218)..(1218): n is a, c, g, or t
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacatatagctatgggggatcaactagagtcn

SEQ ID NO: 64844 - DNA, 1275 bp, Homo sapiens
cctccatccacacggtttccttaagcagagcttttctcctcctcttctctgctagtgaagcactgcttaccctcctagcctacagcaagccctgccctgccccatctttctacccaatttctcgctcttctgtttcacactcatttctttttactttggactaattgtggctgttgggactttggcttgattgctaaaatactttacttgtacttcctgatgatacaaacaatcctgcccacttcctctgccagatattgcacccactcgtcaggatttgtgcgtccttgactctgccccacccagtgctcccagcaggggcaggtgcaggaagctcactaggtggagatgttggaattggtttttcttgcagacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccattggggcttcggggaatctggcacttcccttggggccccaacccaatttgcacaagcccaggcacgcgccacgctctctcgcctgtgttcccctggtcctccgcgggcactcaagtgtccccgggggtctttccgccgcgtcagggcatctccccgttgggcactggttggattcccgcgcgttcttgcgcgcccgaagcctattccacgcgcaggtgtcccccatccgcctccaatctttcccaggtccgtatcccctaactcgcggggttccccttggg

SEQ ID NO: 64845 - DNA, 1565 bp, Homo sapiens
  misc_feature (59)..(59): n is a, c, g, or t
  misc_feature (81)..(81): n is a, c, g, or t
cgcagcgagcccggtccccctgtcgttccccggggagcgctgagccggaccggcgtggntggggaaggggagtggcgcggncctgcggggtgaggctgccgtttgctgagtgtccggcaggggtctgctcgctgccagcccggcccctcctcagagcagctgccgcagcccgaggtaatctcggccccgcgccggggctggctgggaacggcgggagcagcttcggtcgcgcggagcgaggggagctggggaccgggcgggcccgggggctgcgggaggcggcgccgccgcacaatcgccccggaatgcccgccagggcgcgcgtggggtgcggccgtcccgccctcaacttcgactgctgcccctgtttaaaaataccccttgcccgcccctccccctcgtttccccgcgtgcccttccgccgcgccccagcccccgcatgtccccccgcgctggcccctccccggggactgctctgccttttactaatttgtcctctcgcggaattggcccccggcctgcggagggaggggcggggagacaccgtgagtaagagatagtcagagaccgtgccggagagataagggagagccgagaggaagcggggtaggagccccaggaggaggaggaggagaaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccaggtgagggctcccctggggaggaggggcagcaggcactgggggagatgcggaaggatgacccacaatacctgcagttagggccacaccctgtgggccagccctccctctagcaggtatttgacctctcagtgccatctcgggtctgtcatgtgtgaagtgactgggctgggcaggtatttcggctggcagttttcctaggtggttgtatgtatcaggtggaaagtgcttgaaagaacagaaagacttttgtgttatatcctgtgggacaaattccactcctcccggaggtcggtctcagttgccccatctgagaaaggagtgttcgctgggga

SEQ ID NO: 64846 - DNA, 930 bp, Homo sapiens
agtcgctctggtgagcgcgacgtaatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64847 - DNA, 755 bp, Homo sapiens
ggtccgtggttgacgtggctgatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctccggctcggggaggccccggggctgggaacgcctgtgccttcctgcgccgaagccaacgccccctctgtcgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 64848 - DNA, 731 bp, Homo sapiens
accctgcctagccccagccccctcctggggacccaacccctcccccatcctgttgggcaggggctgcgcctcactgaccttcactcactctcctggaccaggcttcaagctcaacaagaagctgtacgagctcatcatcacccgctactcggagcccgacctggcggtcgactttgacaatttcgtttgctgcctggtgcggctagagaccatgttccgtgagtgtccccaactgcctcccaccctccagctccgtcccaaacgcgtcccccaggagctggggggaatgacagatgggtgaattagcagatacaggccagtgctgtgggtgtgtgccagagaggcctgggtctgggtttggggggccctggctgagtgccaggagagtcggggagggagggagttgacagtggcttctcaggcagcaggaaggggtgaagcttcccagcttcaaggggtgtcagcttgcggtactgtggggaggtagagagggaccaggcaggaagggggccaggcctggccctgcgtgaatatcccactgagttttcagccctgtatcaccttttcttgaacacacaggatttttcaaaactctggacacagatctggatggagttgtgacctttgacttgtttaaggtgggaacctccctgggcccatggttggggaagagttccaggcgatcgaattttcttatctggccagtgttccctgtcctttcctggaaatga

SEQ ID NO: 64849 - DNA, 1384 bp, Homo sapiens
tgagcgtccgggcccaggggctccacacagcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaaaaaaaaa

SEQ ID NO: 64850 - DNA, 1442 bp, Homo sapiens
tgagcgtccgggcccaggggctccacacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaaaaaaaaa

SEQ ID NO: 64851 - DNA, 1528 bp, Homo sapiens
tgagcgtccgggcccaggggctccacacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaaaaaaaaa

SEQ ID NO: 64852 - DNA, 822 bp, Homo sapiens
tgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccgcctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccacacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatggttcctctctgttcccttcctgtctctctctgtctccctctgctcaccttggggtttctctgactgcatcttgtccccttctctgtcgatctctctctcgggggtcggggggtgctg

SEQ ID NO: 64853 - DNA, 2988 bp, Homo sapiens
taactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtaacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaataaaaaaaat

SEQ ID NO: 64854 - DNA, 3136 bp, Homo sapiens
agcggcaagttctaaggccttactgatttccagtcaacttgttctatccattattgagagacgagtgttatagtcagcaactataattagccgtctgttctcaggccaagcttgcttcctactctgccataaggtgagccatctctacctgcctggagatggacctgcggtcatccagttccaccagtgcctggctggagctataagttggtgctgtttgccagggttggtgtctacagagggccaggggaattccaagcgagggactcaaggagagcttcttggactcctcaagttctaccaggaggcagtgctatggtgtgcccaaccctcccaggggcctaagtggccaccctcttgggaatgcccaaagcatctgctatttaggacttggttacagagcaccatcagcttccccaagtttgcaagcaagcattttcccaggagatagagtggccaaggtattgcttgtgtctgacccccttcttctgtctgaaacaagggctaccctccacccagccactgtctaaagagcttcatttaaagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtaacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaataaaaaaaat

SEQ ID NO: 64855 - DNA, 356 bp, Homo sapiens
tggctgggggtggaggggagttgggaaaagctcattctgcttttttggaggtagttcttgagttccatactgtcaatgggttgccacagttgggctggcctcttcttacagtctgtgggcctcaatttccccaccttttggactttgccacagctctacagtgctgagactctcggccttggaaatggacctatgtgagcgggggtgagaagggagtcctggctgtattttcattgttccacctccattctgcctttcccctccccagatggcatgatcaacattgacatgactggagagaagaggtcgttggatctcccatatcccagcagctttgctcccgtctctgcacctag

SEQ ID NO: 64856 - DNA, 238 bp, Homo sapiens
tccccagcactctgcccagcccaagctctcccagcctctgcctcccatcccccaggaggaaagacagtgcccaggctgggccaggcagctggccctggtgcccatgagcagaggggaccctccctggagaactcgaaaatgccagtgaacaaggcccaaacacctccatcctgagtccttctccagccttaaagcaaatcatcttttaatcctgaaacaccaaatatttaatttatgc

SEQ ID NO: 64857 - DNA, 701 bp, Homo sapiens
ttgtctttttattaatggccatttggactggtgtgagatgatatctcattatggtttagatttgcatttttctgatgattagtgatggcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgatgaactcctactaattttcgtccttcagaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 64858 - DNA, 974 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggatatgttctgggagtaactcccctgctttccctggatgtgtgcgagaaagcataggcatccactttctgaccaacaggagacccagtctcaggatggagcagacaccatgcatggtagagcagagagacagatacaacctaggtccttgatgaaatgattggccactggatcagccacagttaaagactgcctacctttggacttctggttatcttaggccaaaaatgtcctttttgtttaaggcactttgagccgggttttctaagacctagcagtctcaaccatccaaactaataagctgaattaactagatttcctgtcatgtccttcctgcctgattggtagcccttgactccaatttggcctcattttccgtaccttactggctgccttttcctctactcataggtcacttggaaataaaatatagatttacttc

SEQ ID NO: 64859 - DNA, 1096 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggtaaaagcaaaaggaaaatgaggttcttcagggcacagtgtgtgggaagcaacagcatgatggaatcattaggagagatgcccatgactcctgcgcccagcaggagttgtttctgcaggggtccctgcttccatctcctaagttgcaggcagagagggcagaagccaggatcatcaatacccaagagggagcatcgaagagtgcatgcttcctctactatgtcgtgatatagatggaggccaggatttgggagctttggaacacatctctcccaggcctgattgttaggagaggacttaggcaaggtgtgggcaatgctggtgcttcacctttccttgttgaccagacagacccagaagggtcatttgtcaaaacaaagaaaatctcttccaggggtgaggcaggtgtggctgcctgtatgtgaatgtgctgcacacctttcccatcagcaggtgtctgagaccctactctcctcctgactttgttggcccgagcatcagcctgtgaggtccagcacccagagcccaaatcttctggctcctaggctggcacacaacctaaca

SEQ ID NO: 64860 - DNA, 1028 bp, Homo sapiens
ggaaggagtgagcatggtagaaagatgtggctacaaagaggaacacacatgtggttcttgccctttaggagtttaattcaagtatgggggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggtaaaagcaaaaggaaaatgaggttcttcagggcacagtgtgtgggaagcaacagcatgatggaatcattaggagagatgcccatgactcctgcgcccagcaggagttgtttctgcaggggtccctgcttccatctcctaagttgcaggcagagagggcagaagccaggatcatcaatacccaagagggagcatcgaagagtgcatgcttcctctactatgtcgtgatatagatggaggccaggatttgggagctttggaacacatctctcccaggcctgattgttaggagaggacttaggcaaggtgtgggcaatgctggtgcttcacctttccttgttgaccagacagacccagaagggtcatttgtcaaaacaaagaaaatctcttccaggggtgaggcaggtgtggctgcctgtatgtgaatgtgctgcacacctttcccatcagcaggtgtctgagaccctactctcctcctgactttgttggcccgagcatcagcctgtgaggtccagcacccagagcccaaatcttctggctcctaggctggcacacaacctaaca

SEQ ID NO: 64861 - DNA, 672 bp, Homo sapiens
ttgtctttttattaatggccatttggactggtgtgagatgatatctcattatggtttagatttgcatttttctgatgattagtgatggcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 64862 - DNA, 1218 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggttattttttccacagatgaatttctaatcctaaataatcatttacatgaattcagatttttttgatccaggcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgatgaactcctactaattttcgtccttcagaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 64863 - DNA, 1267 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggtctgttgtggggaaagtcagatgatgtgagtccttgttcacacagtaagtgcccagaaaaccttggtgcttttcctcttcccttccctgaagctgaacttctgcggaaaaatccaagaggcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgatgaactcctactaattttcgtccttcagaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 64864 - DNA, 1196 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggttattttttccacagatgaatttctaatcctaaataatcatttacatgaattcagatttttttgatccaggatatgttctgggagtaactcccctgctttccctggatgtgtgcgagaaagcataggcatccactttctgaccaacaggagacccagtctcaggatggagcagacaccatgcatggtagagcagagagacagatacaacctaggtccttgatgaaatgattggccactggatcagccacagttaaagactgcctacctttggacttctggttatcttaggccaaaaatgtcctttttgtttaaggcactttgagccgggttttctaagacctagcagtctcaaccatccaaactaataagctgaattaactagatttcctgtcatgtccttcctgcctgattggtagcccttgactccaatttggcctcattttccgtaccttactggctgccttttcctctactcataggtcacttggaaataaaatatagatttacttcaaactcccactatcacatgcatttcttttcttactgacttcacggccttcaaatacggcctcataatcatttactctctgttaggttcctccaatgacttggatcactcctagcctgtcttgattggccacctccacactaatgccaaaaa

SEQ ID NO: 64865 - DNA, 852 bp, Homo sapiens
gaaaatgtgacaggatatatgcagtttccttaggggcacattctgagatgcttggatgacccacaaggactttgttaaacacaaatcccatcaggaaacaggcagttcactatgaccttatgaaagttttaattcaaagcacttgaagatacttttttttctgggcttcctgatcttacttcagtaaggtttttataaagttaatatccaagtaagagtatagctttcaaaggctattcctcattcttaaatgcattaaactgttgattaataacattatctaaaagctgtcaaataaaaataagaccaaactctttacttgtacagagtggactgatcaagttgaaagcaacagaacaagcatctataagaattgattatatgtcccagcactttggaaggctgaggcaagtggatcccttgggcctaggacttcgcgagaccagttgggcaacatgatgaactcctactaattttcgtccttcagaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 64866 - DNA, 1045 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggttattttttccacagatgaatttctaatcctaaataatcatttacatgaattcagatttttttgatccaggatatgttctgggagtaactcccctgctttccctggatgtgtgcgagaaagcataggcatccactttctgaccaacaggagacccagtctcaggatggagcagacaccatgcatggtagagcagagagacagatacaacctaggtccttgatgaaatgattggccactggatcagccacagttaaagactgcctacctttggacttctggttatcttaggccaaaaatgtcctttttgtttaaggcactttgagccgggttttctaagacctagcagtctcaaccatccaaactaataagctgaattaactagatttcctgtcatgtccttcctgcctgattggtagcccttgactccaatttggcctcattttccgtaccttactggctgccttttcctctactcataggtcacttggaaataaaatatagatttacttc

SEQ ID NO: 64867 - DNA, 1238 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggtctgttgtggggaaagtcagatgatgtgagtccttgttcacacagtaagtgcccagaaaaccttggtgcttttcctcttcccttccctgaagctgaacttctgcggaaaaatccaagaggcttttctctagggtgaaggtacactcgagcgtggtcattgaggacaagtcgacgagagatcccgagtacgtctacagtcagccttacgagtggactgatcaagttgaaagcaacagaacaagcatctataagaattgattatatgtcccagcactttggaaggctgaggcaagtggatcccttgggcctaggacttcgcgagaccagttgggcaacatgaacaagatggaagaaactacggtcacatatgcaaatggagaagatgatgaacacagaaaaattatgcaaagataatccctaaaccttctttctcatcaaaagttatagcaaggtggtttaatatatcactgacggaacacgatgctttgtttaatgaagactcagacggaaaggatcagacatcaacctataaatgcatcaaccagaaggaaagaccaattttgaaaactgttgagcattattctatacctctaagctgttcttttctgaaccatgaatcgggagaattattgtcactcatacatgagtatgagttgtaattctcaattcccaagtaaaaatcttcctgcttttgttatattttt

SEQ ID NO: 64868 - DNA, 1280 bp, Homo sapiens
tgacttaaaactagagaggatctaggaactggagctgctgcctctgtctgctaagatgtgaagtccaagactgaaagtaacatagcagaaggagaaccaaaagatatgttgagtcttgatgctatttgttgaaccagtcctgaatccagctgtgtcggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggttattttttccacagatgaatttctaatcctaaataatcatttacatgaattcagatttttttgatccagagatggggtttcaccattggtacccaggctggtctctaactcttgagctcaagtgatccacctgcctcagcctcccaaagtgctgggattacaggtgtgagccaccacacctagcctatgttgtctatagttttatcaaggacagactaaggtatattggaattaaaaaaaaagtagattttaaccatgaaggtttatttcttgctcatctccatcatgggctgactgggggctctgctccatgctcctcatttggggatgtatacagaaggagcagctaccacctgagctgctctgcattaattagtctctaatgcagaactaaagatagctaaggaggcctcatttggccattaaagtttctagcctgatggtgacatgtgccacttctgctcactactcattgactgcaacaagtctcacagccccacccagccactaagagccaggaggtacaatcctatcatgtgccaggaaggtgggaattcagaaatgctgggtgaacagcattagtgatgatcacagtggcccatgcagtgtgcatctcctctttctttttcctaggagattgctgactttggttagttttctatctctcctccatgctgaccattaatttaggcaaagctaatcccattttctgacaccaggagtggactttgatgcacttaagcca

SEQ ID NO: 64869 - DNA, 1029 bp, Homo sapiens
gtagattaggaagaggcttctgggacaagctttggagtttcaatatccctttattcacagggagtcagcgcagcttttgaagctggagagcatcatattttagaaagatcaagcaatgtggatgaggacacattaaaaagagaagaccgagaggaggggacaccactcaggcttataacctccagctcacatttcagcaccaaaggaccaaagcctagacctgagatctggcacttgcaaaaagaaagatcacctggaagaacaaaatagaagactcctgctcccaataggcttgggtcaggaagaaggctgttggcataattgtggagtaggaagatggaaaacaactcctagagatcccaacagctgaacgcgtgcttgggcagtggctgcgggtgaagtcatgggaaggcaagtcatgaagggcattaatcaaggatatgttctgggagtaactcccctgctttccctggatgtgtgcgagaaagcataggcatccactttctgaccaacaggagacccagtctcaggatggagcagacaccatgcatggtagagcagagagacagatacaacctaggtccttgatgaaatgattggccactggatcagccacagttaaagactgcctacctttggacttctggttatcttaggccaaaaatgtcctttttgtttaaggcactttgagccgggttttctaagacctagcagtctcaaccatccaaactaataagctgaattaactagatttcctgtcatgtccttcctgcctgattggtagcccttgactccaatttggcctcattttccgtaccttactggctgccttttcctctactcataggtcacttggaaataaaatatagatttacttcaaactcccactatcacatgcatttcttttcttactgacttcacggccttcaaatacggcctcataatcatttactctctgttaggttcctccaatgacttggatcactcctagcctgtcttgattggccacctccacactaatgccaaaaa

SEQ ID NO: 64870 - DNA, 474 bp, Homo sapiens
taaatgtgcttgttaaaaataaagatttcatttgtcaaaacccatagaatgtacaacacaaagagtgacccctaatatttggttgataataatgtgtcaatatcagttcatcagttgtaataactggaccacactgatgtaagatattgatggtagagaggctgtgagctggtggagaagggagtatgtgggaactctctttactttgctcagttttgctgtacacctaaactgctctggtgcccaacgtggaggcttttctctagggtgaaggtacactcgagcgtggtcattgaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctaca

SEQ ID NO: 64871 - DNA, 1687 bp, Homo sapiens
atttcgctttatcgtggtggagtccaccctggctgtggacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcactgtttcctcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctatatatgtaacgaatgtgggaaagcctacaatagattttatttacttactaaacatttaaaaacacactgaagaaaaactctgaatgtaaggaatgtggaaatcttttaggaatttctcataccataattaccacatttgaattcacactgaagagaaattttattggtacaaagaatgtgaggaggccttcagttatccccattcacttcgaagacatgaaagaactcatactctatgtgtcccctataaattttaggaatgttagggagccaatggaatctttttttattattttattttattttatttgagacagagttttgctgttgtcatcacacaggctggagtgcaatggcatgatcccagctcactgcaacctttgtctcc

SEQ ID NO: 64872 - DNA, 2082 bp, Homo sapiens
  misc_feature (54)..(54): n is a, c, g, or t
atttcgctttatcgtggtggagtccaccctggctgtggggctgtcggtcctccntgcgcggccagtggctagaggccgcaggctcagtgggtcccagtcaggagccaggtcgggaagtgtgtttgtcccgactccgcgcgttttctggagtggtttcatccgctgtgctcccttcttcaaaagcttggaaagcaacctttgacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatgatgggactgtctagttgcaggaaaacaagctcaggcctcctgctgatcctattttatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgttacacaacagtgcccctgctggagagacactttctgtgttgaatcagtgcagaaaagccttcagcctgccaccaaatgttcaccagagaacgtggataggagacaaatcctttgaatacagtgactgtgaggaagcctttgttgatcagtcacatcttcaggcaaataggataactcacaatggagaaacactctatgaacagaagcaatgtgggagagcttttacttactccacaagccatgctgtgtctgttaaaatgcatactgtagaaaaaccctacgaatgtaaggaatgtggaaaattctttagatattcttcatatcttaatagtcacatgcgaacccatactggggagaaaccctatgaatgtaaggaatgtgggaaatgcttcactgtttcttcacacctagttgaacatgtaagaattcatactggagagaaaccttatcaatgtaaggaatgtggaagagccttcgctgggcgctcaggccttactaaacatgtacgaatacacactggagagaagccctatgaatgtaacgaatgtgggaaagcctacaataggttttatctactaactgaacattttaaaactcacacagaggagaagccctttgaatgtaaggtatgtggaaaatccttcagaagctcttcatgccttaagaatcactttagaattcacactggaataaaaccctataaatgtaaggagtgtgggaaagcattcactgtttcctcaagcttacataatcatgtaaaaatccatactggagagaagccctatgaatgtaaggactgtgggaaagcctttgctacatcttcacaactcattgaacatataagaactcacactggagagaaaccgtatatatgtaaggaatgtgggaaaaccttccgtgcttcttcacatctacagaaacatgttagaattcacactggagagaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgatttt

SEQ ID NO: 64873 - DNA, 1349 bp, Homo sapiens
cggcggccgttgcagcggcggcggcgagagcggcgggagcccgaggcggcggcgctcgcggcccatcgtggggcccgagctgtgcgcctcggctcggagcccggaccgggcgggggcgccgacgtgcctcagcctgccttcgcgagggaggcgggagtgagcagaaaggcttagggcccagggggcggggaaggggggccgggcctggatccggcggggaggccgagccggaggccggaccgtggctcgcgctgtccccgggacgcggatcgaacgttggcggcgcggatcgcacgtcggcggccggtggaacgcgggagctgggcggcgcgcggactggggccatggcgtctgtgcaggcgtcccgccgccagtggtgctacctgtgcgacctgcccaagatgccgtgggccatggtgtgggacttcagcgaggccgtgtgtcgcggctgcgtgaacttcgagggcgcggaccgcatcgaactgctcatcgatgccgcccgccagctcaagcgcagccacgtgctccccgagggccgctcgcccgggcccccggcccttaacaacccagcatcgccttgtggcccgcaacggcgaagcagaagtcagtcccacagcgggggccgaagctgtcagcgggggtggcagcggcactggggcgacccctggggcccccctgtgctgtaccctgtgcagggagcggctagaagacacccacttcgtccagtgcccctcggtgcccggacacaagttctgctttccctgctcccgggagttcatcaaggcgcagggcccggccggggaggtgtactgcccgagcggagacaagtgcccgctggtcggctcctccgtgccctgggccttcatgcagggcgagatcgccaccatccttgctggagacatcaaagttaagaaagaacgggacccctaggctaccactgcctccaggctactgccctctgcccctttgccacccaccgctgccgcggataaattattccctccccgacccagcccagtgccacctctatctgtgtacatactcccttcttccacccagatgggtcccctggggtagatgcattgtgggtggggggagaaagcttgtggctcctgtccgagggggtgtttggggtcccttggcccctccagtttccctctgtcctccttggcttggctttgctgctgcttgtagttgggggagaggtgcccccctcctccttgagaagggacctcctgaaaactcgctctttataaacgaggcaaaagcatttaattcccacccccccaccccccgctcccttctgctccttcaataaaccgaaagatgggttttttttttcaaacttg

SEQ ID NO: 64874 - DNA, 851 bp, Homo sapiens
cggcggccgttgcagcggcggcggcgagagcggcgggagcccgaggcggcggcgctcgcggcccatcgtggggcccgagctgtgcgcctcggctcggagcccggaccgggcgggggcgccgacgtgcctcagcctgccttcgcgagggaggcgggagtgagcagaaaggcttagggcccagggggcggggaaggggggccgggcctggatccggcggggaggccgagccggaggccggaccgtggctcgcgctgtccccgggacgcggatcgaacgttggcggcgcggatcgcacgtcggcggccggtggaacgcgggagctgggcggcgcgcggactggggccatggcgtctgtgcaggcgtcccgccgccagtggtgctacctgtgcgacctgcccaagatgccgtgggccatggtgtgggacttcagcgaggccgtgtgtcgcggctgcgtgaacttcgagggcgcggaccgcatcgaactgctcatcgatgccgcccgccagctcaagcgcagccacgtgctccccgagggccgctcgcccgggcccccggcccttaagcacccggccaccaaggacctggcggcggcagccgcacaggggccccagctgccgcccccgcaggcccagccccagccgtcagggaccggcggcggcgtgtcgggccaggaccgctatgacagggccacatcatcaggccgcctccccctgccctcgcccgccctggagtacactctggggtcccgcctggccaatgggctgggccgtgaggaggccgtggctgtcgggctagtcggggctgtcggctaatcggactgtcggctagtcggggagatcctcaagcaccag

SEQ ID NO: 64875 - DNA, 2518 bp, Homo sapiens
cggcggccgttgcagcggcggcggcgagagcggcgggagcccgaggcggcggcgctcgcggcccatcgtggggcccgagctgtgcgcctcggctcggagcccggaccgggcgggggcgccgacgtgcctcagcctgccttcgcgagggaggcgggagtgagcagaaaggcttagggcccagggggcggggaaggggggccgggcctggatccggcggggaggccgagccggaggccggaccgtggctcgcgctgtccccgggacgcggatcgaacgttggcggcgcggatcgcacgtcggcggccggtggaacgcgggagctgggcggcgcgcggactggggccatggcgtctgtgcaggcgtcccgccgccagtggtgctacctgtgcgacctgcccaagatgccgtgggccatggtgtgggacttcagcgaggccgtgtgtcgcggctgcgtgaacttcgagggcgcggaccgcatcgaactgctcatcgatgccgcccgccagctcaagcgcagccacgtgctccccgagggccgctcgcccgggcccccggcccttaagcacccggccaccaaggacctggcggcggcagccgcacaggggccccagctgccgcccccgcaggcccagccccagccgtcagggaccggcggcggcgtgtcgggccaggaccgctatgacagggccacatcatcaggccgcctccccctgccctcgcccgccctggagtacactctggggtcccgcctggccaatgggctgggccgtgaggaggccgtggctgagggggcgcgaagggccttgcttggctccatgcctggcttgatgccccctgggctgctggcagctgcagtgtctggcctgggaagccgaggcctgacgctggcacccggcttgagtcctgcccgtcccctcttcggctccgatttcgagaaagagaagcagcagaggaatgcggactgtctggcagaactgaacgaggccatgcgaggccgggcagaggaatggcacgggcgccccaaagcagtgcgggaacagctactggcgctgtccgcctgcgccccgttcaatgtgcgcttcaagaaggatcacgggctggtggggcgagtgttcgccttcgatgctactgcccgtcctccaggatacgagttcgagctgaagctcttcaccgaatacccctgtggttccggcaatgtgtacgccggcgtcctggcagtggctcgccagatgttccacgatgctctgcgggagccgggcaaggcactggcttcttcgggcttcaagtacctcgaatatgaacgccggcatggatcaggagaatggcggcagctgggcgagctgcttaccgacggcgtccgcagcttccgcgagccagctcccgcggaggccctgccccagcagtacccagagccggcccctgcggctctctgtggcccacccccgcgagccccatcccggaacctggcgcccacgccgcgccgtcgcaaggcatcccccgagccggagggcgaggcggctgggaagatgaccaccgaggagcagcagcaacggcactgggtggcacccggcggcccgtactccgctgagacccctggtgtgccctcgcccattgccgccctgaagaatgtggccgaagccctgggccactcacccaaggaccctggcggaggcggggggcctgtgcgtgcagggggcgccagccctgcagcctcctccacggcccagccgccaacccagcatcgccttgtggcccgcaacggcgaagcagaagtcagtcccacagcgggggccgaagctgtcagcgggggtggcagcggcactggggcgacccctggggcccccctgtgctgtaccctgtgcagggagcggctagaagacacccacttcgtccagtgcccctcggtgcccggacacaagttctgctttccctgctcccgggagttcatcaaggcgcagggcccggccggggaggtgtactgcccgagcggagacaagtgcccgctggtcggctcctccgtgccctgggccttcatgcagggcgagatcgccaccatccttgctggagacatcaaagttaagaaagaacgggacccctaggctaccactgcctccaggctactgccctctgcccctttgccacccaccgctgccgcggataaattattccctccccgacccagcccagtgccacctctatctgtgtacatactcccttcttccacccagatgggtcccctggggtagatgcattgtgggtggggggagaaagcttgtggctcctgtccgagggggtgtttggggtcccttggcccctccagtttccctctgtcctccttggcttggctttgctgctgcttgtagttgggggagaggtgcccccctcctccttgagaagggacctcctgaaaactcgctctttataaacgaggcaaaagcatttaattcccacccccccaccccccgctcccttctgctccttcaataaaccgaaagatgggttttttttttcaaacttg

SEQ ID NO: 64876 - DNA, 2261 bp, Homo sapiens
cggcggccgttgcagcggcggcggcgagagcggcgggagcccgaggcggcggcgctcgcggcccatcgtggggcccgagctgtgcgcctcggctcggagcccggaccgggcgggggcgccgacgtgcctcagcctgccttcgcgagggaggcgggagtgagcagaaaggcttagggcccagggggcggggaaggggggccgggcctggatccggcggggaggccgagccggaggccggaccgtggctcgcgctgtccccgggacgcggatcgaacgttggcggcgcggatcgcacgtcggcggccggtggaacgcgggagctgggcggcgcgcggactggggccatggcgtctgtgcaggcgtcccgccgccagtggtgctacctgtgcgaccggcggcggcgtgtcgggccaggaccgctatgacagggccacatcatcaggccgcctccccctgccctcgcccgccctggagtacactctggggtcccgcctggccaatgggctgggccgtgaggaggccgtggctgagggggcgcgaagggccttgcttggctccatgcctggcttgatgccccctgggctgctggcagctgcagtgtctggcctgggaagccgaggcctgacgctggcacccggcttgagtcctgcccgtcccctcttcggctccgatttcgagaaagagaagcagcagaggaatgcggactgtctggcagaactgaacgaggccatgcgaggccgggcagaggaatggcacgggcgccccaaagcagtgcgggaacagctactggcgctgtccgcctgcgccccgttcaatgtgcgcttcaagaaggatcacgggctggtggggcgagtgttcgccttcgatgctactgcccgtcctccaggatacgagttcgagctgaagctcttcaccgaatacccctgtggttccggcaatgtgtacgccggcgtcctggcagtggctcgccagatgttccacgatgctctgcgggagccgggcaaggcactggcttcttcgggcttcaagtacctcgaatatgaacgccggcatggatcaggagaatggcggcagctgggcgagctgcttaccgacggcgtccgcagcttccgcgagccagctcccgcggaggccctgccccagcagtacccagagccggcccctgcggctctctgtggcccacccccgcgagccccatcccggaacctggcgcccacgccgcgccgtcgcaaggcatcccccgagccggagggcgaggcggctgggaagatgaccaccgaggagcagcagcaacggcactgggtggcacccggcggcccgtactccgctgagacccctggtgtgccctcgcccattgccgccctgaagaatgtggccgaagccctgggccactcacccaaggaccctggcggaggcggggggcctgtgcgtgcagggggcgccagccctgcagcctcctccacggcccagccgccaacccagcatcgccttgtggcccgcaacggcgaagcagaagtcagtcccacagcgggggccgaagctgtcagcgggggtggcagcggcactggggcgacccctggggcccccctgtgctgtaccctgtgcagggagcggctagaagacacccacttcgtccagtgcccctcggtgcccggacacaagttctgctttccctgctcccgggagttcatcaaggcgcagggcccggccggggaggtgtactgcccgagcggagacaagtgcccgctggtcggctcctccgtgccctgggccttcatgcagggcgagatcgccaccatccttgctggagacatcaaagttaagaaagaacgggacccctaggctaccactgcctccaggctactgccctctgcccctttgccacccaccgctgccgcggataaattattccctccccgacccagcccagtgccacctctatctgtgtacatactcccttcttccacccagatgggtcccctggggtagatgcattgtgggtggggggagaaagcttgtggctcctgtccgagggggtgtttggggtcccttggcccctccagtttccctctgtcctccttggcttggctttgctgctgcttgtagttgggggagaggtgcccccctcctccttgagaagggacctcctgaaaactcgctctttataaacgaggcaaaagcatttaattcccacccccccaccccccgctcccttctgctccttcaataaaccgaaagatgggttttttttttcaaacttg

SEQ ID NO: 64877 - DNA, 292 bp, Homo sapiens
ttggctatacactcttcaaagtcagaacttgcaatttcaaattcagtgcaattaaatgtaaattatagtcactgaagacccactgtattccagacaccatggaacgtgttaagagcaagagagatgagtaaggcataacccttaccctgaaagatatcatagtccagaaaaggagacaaagacctaacaaacaatcctgattcaaggcactacatgaagatgcaggaatacacacaacatacagcggtagcacagaagagggggcaggctctacctatgcaggcggggctgt

SEQ ID NO: 64878 - DNA, 427 bp, Homo sapiens
acagtttgtgctaacctgatagtgggaccaggcaggcacatccagtagtcttggaatatggccacagtagaaagaccaaccatgtgattaggaagttgaagctttgggtcacatgatattgcctcacctctggagagagggacctggagattttattcaatcacactgacaatgaatcaatcaatcgtgtttgtatagggaagcctcaataaaactctagacactaaagctttggtgagagttgcaggttggcaatacctctagtgcattgtcatgtaatgtatgtaatgtcagaagggtaacacgttctgaggatgtggaaaattcccgttaagaaccctcccagactcttccctatatgttttttttcccttgagtgcttttaatgcataatttctctataataaacataaatctgagtataata

SEQ ID NO: 64879 - DNA, 886 bp, Homo sapiens
tgccactggagagctttgaggagaggatcagtctggctactgggttgagaattaatcatagcaggcaaaggcaaaagaagtgaggttagttaggaggctttacaacaacccagatgagagatgggaggttttagccagggagatggagatgttgagagagtagctggactcaggattgtgacagtggactgaaggaaaagcaggttttgggggaagattgcatttctcccttcaacttcagttacgtagatcacccatatgccacacaactgcaactctgtaacagccaatttttagcttcttccttatctaagccatcctgtaggccataggaattaaaactaggttggatcaaggaaaagtgaatgctagatccatacaaaactatttggatatttgcctttgtattttattgttttgaaattatttttaatggttcaataaactcttactagaactacaagcaatataattatttcctctgctttattagaaatgtttttgtaatcatgttaattatattacttttaactatataaggcttgtgtctcttttttataaattgatgtttatatcctctgtaagataaatataaaggctttttgttcatatgaggatgtgctgtaagattgcagggagtataaaaattggcaatggagtaggtgacttgtattattagtctgatcttaatgttgtaacatactgatcatgcaaaatatataattagtttgtttttgctatttaatatgtgtaggactgtaacaaacagactagagaagatggccttaagttacaagaaagcaagtaaattactatctaattaaaagtatttgattctaatactagcagagttctgtctagaaaataaattaactttctgtatgct

SEQ ID NO: 64880 - DNA, 709 bp, Homo sapiens
agcggggagggctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgc

SEQ ID NO: 64881 - DNA, 723 bp, Homo sapiens
gcccacagtgcccagggagggatacatggcagccccagggtgtggggcaggtgggcagggcactaatgaggggcctcgagtcccaggccaagggctcagacttcctcctggggataatgggaaggagaacctcatggccaggtttgtgcccttagtgaggtccccaagggggaacctggaaggaccactgtcttcttatagcccttcagacccccccagaggctctgcctccccacaccctggcctccctccccaggctctgggaggccaggcctcgccccctctcctgtgctgctccttctcccagaggactgcatccgccctcagcacttcaaggccctgcatgtgcccgcacctctccactcccctggctcagcttggacctctcttctgaactccagacttgcggatcctgctccccttcccacttctgcacttgggggtctaatgaggcctcagtggaacatagaattcctcccgccctgacaacatagctcccgcctgggaggcctcctggatgactcctttcgcctcctcccttccctgagagcagcccctggctcaacctccacctccgtgctgcctcggaccacctgcccagtcgagctgccatcacctgccaggtgaccacagcagccctcactcatcccctgctcctctgccttccactcccgcgaccatcagcctccccaagccagaaaggtccttctggagggtgacgca

SEQ ID NO: 64882 - DNA, 417 bp, Homo sapiens
aaattctaacccttgtgcattgctgctgggactataaaatggtgtggtcactgtggaaaacagtatgatgattccttaaaaaattaaaaacagaattaccatatgattcagcaattccatgcctgggtatatacccaaaatgaaagcaggcactggaacatagaattcctcccgccctgacaacatagctcccgcctgggaggcctcctggatgactcctttcgcctcctcccttccctgagagcagcccctggctcaacctccacctccgtgctgcctcggaccacctgcccagtcgagctgccatcacctgccaggtgaccacagcagccctcactcatcccctgctcctctgccttccactcccgcgaccatcagcctccccaagccagaaaggtccttctggagggtgacgca

SEQ ID NO: 64883 - DNA, 326 bp, Homo sapiens
gcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaaga

SEQ ID NO: 64884 - DNA, 184 bp, Homo sapiens
ggacttgtggtggtggagccgagcccaggtctccctaaaccctgcctcctgtctctgctgtccaccccaagagacctccgtgcttctgtttcagctttcccgaaagccgtgctggccccatctgccatcctgcaaccccggcaacacccgtccaagatgcttctgttgcttcctgaggccggcc

SEQ ID NO: 64885 - DNA, 435 bp, Homo sapiens
tctgattagaaaccagagtcctgctatttttaaatgaaagggaaaaaaagaaatcaagaaatagcaaggaaaacctaaagaaagtacaaaaaagaaaagggaagaagcagcggcaaatgaaggggtaggcaacaattttgcagctgagcttttggagcgtgccagtatgaataccaactgccagcgtgcagaatcccagaggctgcaaatcaagcttagcatcagcctgctgcctggaaaagcagggaaagggcagggccccaacaagacagagagggcctcctaggtgccaagcactgtgtcaggtgctttacagcatctcaatgagcaagacactagcactttaaaaccaaatccagcgctgaattaataacacagccaagagctctgaaagacaccctgaaagcaaagctgtttatgattgtggggccaagg

SEQ ID NO: 64886 - DNA, 363 bp, Homo sapiens
  misc_feature (56)..(56): n is a, c, g, or t
  misc_feature (205)..(205): n is a, c, g, or t
  misc_feature (249)..(249): n is a, c, g, or t
gagacacttattaaataatatgtaatatggtttggctctgtgtccccacccaagtntcatcttgaattgtactcccataattcccacgtgttgtgggagggaccagatggcagataatttgaatcacgggggcggtttcctccatactgttctcgtgatagtgagtaagtctcacgacatctgatgggcttatcaggggtttctncttttacgtcttcctcattttctcttgtcaccaccacataagangtgccaacctccccagtaccaggcactgttctaggcacttgacataagtaatgaacacagtcgacttggccctgagccttaggacagttgcaaaaccttgctactcacagtgag

SEQ ID NO: 64887 - DNA, 421 bp, Homo sapiens
aacggagtgggtttggttaccagttggccatttgcagcgagctcccccctccgcccaactccaccccataccttagagctgtgggcatcgcgggcaaaaataggactcagtgctgccactgggagtggctccctggctctgcccctgggttctctgggtagggagttggcagctggactctctgttatccaccggtgatatctgggccttgtgatgggtgctgggaaccctgaggatgtacttgggacatagcttatattctgggggagccagagagactccagtcatttccctatggcacgatggggtaggggccatatgaactatggcaacccagcacaatgccaggagagcttcccggaggaggtgatacctggcctggatcttaaaggatgagcaggagctcatgagaaaaaaaaaa

SEQ ID NO: 64888 - DNA, 397 bp, Homo sapiens
ttttaaagacatcttaactacgaaaaagagattgctgatctaaattgatgatatactgttaatacaaagcttttggtgtatcttacatgacataacattatgaaaaatacaatagagtatgtcatatagatgttactctaaactttaaaaaaagactacaaagtgttctatgcataattacattatttaaggggaaaaaggtgttggctgacactattccagctagacagtactgaattgcaaattcatcatttgggcacagatattaatacagcttcctctttattcctatagcattcatttgaaatccctgtactccatgtcatttgctacatatgaaacaaattgtcaagtttttaaccacttgtgtagtttaataaaagagattaaaatcatt

SEQ ID NO: 64889 - DNA, 1113 bp, Homo sapiens
tgcagagttggggcaatgtgcccttgaaggagactagagcagcttgcccaaggacagaggtggaaagtgacctgctctggacttgtgaggccaaggtcatggggaacattcacagttggcctgtgcacacttgcagccccactcagataagacagtggggcggacctcctggggccaacagcaaggaccttctgaacctcgctcggtcaggatcagggtgtggtcagcaagcattcttctgtctccttttccttcacttatttcttctgataatatggcctttatggctacgttagccagaaattgagcttcagaaaactaacttgaaaaacagcttttcagcagctttctcccctgggatgtgcgtgccctcctgttcatgggtcagcaatatctctttcctttgccggtgtctgcaaaccatagagaagacagtatgaaaaagggccaggccaggccatgactcttctgggagcatctagaaagtcgtgggatggatgagaacactttggtctgatctgtcagctgtgtgtgataaagtcagatggcttgttccaaaggaatatcactcttgaagaaagcttcacctcaccccctcaagaataccagtggttctcaacgcatggtcttcagacctgcagcatcagcattacctgagaacttttgagaaatacaaattctggagcccatcctggacatctggaatcagaaaccctgggatgggacctgacacctgtgtttataacgagcccttcagatgctccagaggacactcgggcttgagaaccactggcctgtacgcctcaaaccagggcagatgaaggcacttctaaaacagaattgggattagtgtcctggccttggccctattaaacaaacagcaagcaaatgatgggctgtggatggcgcaacacagtttcgtggctccaggtgtctttagaatcatgactcgggttgatttcttgctttccctgtactgtactttgcatgtttcctcatctgtaaaacaagggccgtatgtaactgaattctgtcctagttactattgatgtacatcaaaccacccctaagtttagtgacacaagataacaacaattttatattcctcgcaaa

SEQ ID NO: 64890 - DNA, 651 bp, Homo sapiens
tgaagcgataagacgcacggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaa

SEQ ID NO: 64891 - DNA, 661 bp, Homo sapiens
tcctggctaacatggtgaaactccgtctctactaaaaatacaaaaattagctgggtttggtggctcgcgcctgtaatcccagctactcggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaa

SEQ ID NO: 64892 - DNA, 616 bp, Homo sapiens
cacacccacctcaccccccccccccgccacctccaaggcccgccactatacggctaggtacgaggctggggtgtgccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaa

SEQ ID NO: 64893 - DNA, 1003 bp, Homo sapiens
tgaagcgataagacgcacggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaaaaaaaaaaaaaaaaaaaaaaaaaaaaaaaaaaaaaaaaaaaaaaaaaaaaaaaaaaaaacaaaaaaaaaaaaaaaaaaaaaaaaaaaggggggggggggggcggcccgaaaaaaaatttcttcgaacacacggtgtggggggggggcgagcgccagatagtgtgaggagagcaacggtggccaacaagcgtggtcctcccagagaaaaactcgcgcgagaagagaggcgggggggggctccccaccaaaaaaaaaagcgcgggggggacacggcgtcgctctgacacacacaccgaggggttgtgggacaacaggggaggtacaacggggacgcacggagggctgaaatagc

SEQ ID NO: 64894 - DNA, 1027 bp, Homo sapiens
tgaagcgataagacgcacggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaaccttgggttttacctggatttttgtcattgacagctcaaaatattctaatatagaagtatacatcattaaatcaaaaaaaaaacaaaaaaaaaaaaaaaaaaaaaaaaaaaggggggggggggggcggcccgaaaaaaaatttcttcgaacacacggtgtggggggggggcgagcgccagatagtgtgaggagagcaacggtggccaacaagcgtggtcctcccagagaaaaactcgcgcgagaagagaggcgggggggggctccccaccaaaaaaaaaagcgcgggggggacacggcgtcgctctgacacacacaccgaggggttgtgggacaacaggggaggtacaacggggacgcacggagggctgaaatagc

SEQ ID NO: 64895 - DNA, 424 bp, Homo sapiens
gccatcagcagggccgcggggcacgactggataaccgcttgtgaagaaaatcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaa

SEQ ID NO: 64896 - DNA, 577 bp, Homo sapiens
tcctggctaacatggtgaaactccgtctctactaaaaatacaaaaattagctgggtttggtggctcgcgcctgtaatcccagctactcggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaa

SEQ ID NO: 64897 - DNA, 936 bp, Homo sapiens
tgaagcgataagacgcacggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaatgtaagttgagaatttctaatttacatcgggatgtgttctaatgcgcttgtttttaaaactgtggaaaatttttaaaagaaaataaatctcaccagtcatccagctacccagaagtaacattttcatgcattacctattaatttttttctctgcatattttttcatagttgagataatttagggaaaaccattttgtgtccttcatatatggatgaatacaatataattttggtattaatatcatagcaacaaagaaggcattgaaggctttaaatctgtttacagtgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaa

SEQ ID NO: 64898 - DNA, 661 bp, Homo sapiens
tgaagcgataagacgcacggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgagtagccaaagcagaatgacagtgaaagaaagaaattgggagccagacaatacagcccgacagtttacgcctgtacggatgtacctctttcacaaaagattgagtatgcttggggaaaaaaaatacacactataataggagaaaatgatgaagagaaactgaggtaaaggtaattggaaaacaaaataaagccaggggtatattaataccccaaaacttca

SEQ ID NO: 64899 - DNA, 946 bp, Homo sapiens
tgaagcgataagacgcacggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaatgtaagttgagaatttctaatttacatcgggatgtgttctaatgcgcttgtttttaaaactgtggaaaatttttaaaagaaaataaatctcaccagtcatccagctacccagaagtaacattttcatgcattacctattaatttttttctctgcatattttttcatagttgagataatttagggaaaaccattttgtgtccttcatatatggatgaatacaatataattttggtattaatatcatagcaacaaagaaggcattgaaggctttaaatctgtttacagtgaattgaaaagacaggatgaagtggacacagcatgtgaagacaattctttcaagaagtttggctgtcaaggaaaacagagaatgtgagtagccaaagcagaatgacagtgaaagaaagaaattgggagccagacaatacagcccgacagtttacgcctgtacggatgtacctctttcacaaaagattgagtatgcttggggaaaaaaaatacacactataataggagaaaatgatgaagagaaactgaggtaaaggtaattggaaaacaaaataaagccaggggtatattaataccccaaaacttca

SEQ ID NO: 64900 - DNA, 384 bp, Homo sapiens
ataaacaaagagaactctaaagacaagcatttagcaacttcttgtggcttagggacaaactcaacccattctctacattcacagtttggggttcttaagaccacaataaaaagttgtaaggggaagaaataaattttggaaggctttatgctagtttttcctctggagcctgctactgtctgactgggctagtcctggaagaataactattttcaagcacctccaagaattcttctttactctaaggaaatattaattaaattactacagttgctacagccaccttgacccatgagcattcacacttgttcatttctttggcaacagctctcctggccagaccatttttcaatggtctggagctgatgctaggggttcctatgt

SEQ ID NO: 64901 - DNA, 411 bp, Homo sapiens
gtttgaaaagaaacattcacatagctgatgatgtggtaggtctcaggttctgtctcatgtgtgataaaccaaaccagccagtatttcaagaagcctagggctattggtaggttaacaccgtgaagatcttcagtgaattcagcttttaacataaagagccaccgcacggtgtttcaattacagaaagaacaactttttaaaaccagagaatgttttcagagctttgctaattcattgtattttatttttgaagtttaaaaacttaatgtgagagttaatccagttcaacaaggtggctctggaagtaccaagggtgaataatagccaagacgcttaggaaaaatagcacttgctctagcagctgtcaaggcctaactacttaatacaaagctaaagttagttaaccctgtt

SEQ ID NO: 64902 - DNA, 809 bp, Homo sapiens
atgcttagtagatgcattgcagaggggaatcaaacctaggcctggtaataacaatagtaaccaatctgtatttcccacttatgagcctgggggcattacctgtgttatctcactcaattccaagattgggtattattttattcccattttgcagatgaagaaacaggagtagagaagttaagtaagatcacacatttgaaccctggtagtcttggccccagaggctaaaaatcttaacaactatactgataacactcaatgcttcaaacatttgatatgtcaacaaacaaactagaaaacttgagcctgggaggttgaggctgccgtgagctgtgaccatgccactgtacttccgagcctaggtaacacagcaagaccctgcctccaaaaaaaaaaaaaaaaaaaaaaattagacgctatttgtaatgaaatttggtttcttgtatttttctgtctctgataaagctgggctgtaacgtgacacattgtcaatagatgccatttctaacaaataacaagtatcctgttttgagaatttgtttcaggctactaatgacttcaagaacatcagaataatacaatagaaagaatttggaatttggaatcaaaagactgattcttctgaaccagctctactacttgttggctttgtgacatttggtaaattactcaacctgcctgagcctcaatttcttaatttgtaaaaagaatgtcctcctagggttcccccctttttccttctttctttcatctcttcaatgagatagtgtgaaagtagtttgtaaatgattaaaggctatgtgacagta

SEQ ID NO: 64903 - DNA, 898 bp, Homo sapiens
tgccatcgatatttatttgtttgtttgtttgtttctaaatagagatggggtatcgccaggctttccaggctgttctccaactccaggactcaagtgattctcccacctcagcctcccaaaatactgggattataggtgtgagccattatgcctggtcccaaggtgccagttctatgccttccagccttggttctctgagaaccgaattaatgaaagatgcagggctctttcccagaggcccaagaaaagaaagatgcaactaggaaagaaggaaggcaaggaggtcattttcttttgacccatgttggacatttaagaaggggatctaggagggaaaattcaacagggggtgattctaactcatatcctttaaagaaacaattatttctccacccagttttttgagggcaggacatggagggtcaggcccagctggaggcgcaccaaagcccagagaaaattcagaaccacgtgaacttgttggatttcagccccttgaagcacatgttgctattgcagctgccttgataactggggggacaggaggagcacggctttcccatcttgtacggggactcgccaatccagttgcccctggaagagaaaaggacccagggagacagaggagcattaggctactaatgacttcaagaacatcagaataatacaatagaaagaatttggaatttggaatcaaaagactgattcttctgaaccagctctactacttgttggctttgtgacatttggtaaattactcaacctgcctgagcctcaatttcttaatttgtaaaaagaatgtcctcctagggttcccccctttttccttctttctttcatctcttcaatgagatagtgtgaaagtagtttgtaaatgattaaaggctatgtgacagta

SEQ ID NO: 64904 - DNA, 751 bp, Homo sapiens
tcttcctttcatctaacatatttattgagcacctactatgtaccaggccttgtgctagactctggggatatggaaatgagcaaagtagatgtacccccgaaacttgtggactaatggaggagacggaccttaatcagatcgtcattcaaagatactattacaaactgttctgagagccgaggaagcaggaaggagctgtgagagactgagctctaaccttggccatcaaagacaagctgtgcagctctggttttttgagggcaggacatggagggtcaggcccagctggaggcgcaccaaagcccagagaaaattcagaaccacgtgaacttgttggatttcagccccttgaagcacatgttgctattgcagctgccttgataactggggggacaggaggagcacggctttcccatcttgtacggggactcgccaatccagttgcccctggaagagaaaaggacccagggagacagaggagcattaggctactaatgacttcaagaacatcagaataatacaatagaaagaatttggaatttggaatcaaaagactgattcttctgaaccagctctactacttgttggctttgtgacatttggtaaattactcaacctgcctgagcctcaatttcttaatttgtaaaaagaatgtcctcctagggttcccccctttttccttctttctttcatctcttcaatgagatagtgtgaaagtagtttgtaaatgattaaaggctatgtgacagta

SEQ ID NO: 64905 - DNA, 754 bp, Homo sapiens
atgagagtaagattatatgggagaaaaagaatcagagatgcagagaccaaaacaaaaacaggcagagatagaacggacagtagacaaaagagagagagaccgaggcagagatagagaaaaaaaggcccagagagagtcccctcaggccaactttggttttcacttctcagttctgagagccgaggaagcaggaaggagctgtgagagactgagctctaaccttggccatcaaagacaagctgtgcagctctggttttttgagggcaggacatggagggtcaggcccagctggaggcgcaccaaagcccagagaaaattcagaaccacgtgaacttgttggatttcagccccttgaagcacatgttgctattgcagctgccttgataactggggggacaggaggagcacggctttcccatcttgtacggggactcgccaatccagttgcccctggaagagaaaaggacccagggagacagaggagcattaggctactaatgacttcaagaacatcagaataatacaatagaaagaatttggaatttggaatcaaaagactgattcttctgaaccagctctactacttgttggctttgtgacatttggtaaattactcaacctgcctgagcctcaatttcttaatttgtaaaaagaatgtcctcctagggttcccccctttttccttctttctttcatctcttcaatgagatagtgtgaaagtagtttgtaaatgattaaaggctatgtgacagta

SEQ ID NO: 64906 - DNA, 457 bp, Homo sapiens
tcatcctgactgggattttggccattctttctcttattttgggttttctgttatcctatggtttctttgcctagttcttgtttttatttgttgttcgaatttttccatcctcctgcaaccacccagtgctattcctatatcactgtgagtataaacaccctttaaccttataggcttcttgaagtataattcccaagaccatgttgcagtggtccttaaagaaccaataaggcagagagaaacaaacatgttccaaattttgttctcaggagtaaaccttactcaattgttaaaggctgtagctagctcaaaagaagtttccttgactctgaaaaacaaaacaaggatcagcaatgttccaagcaaaagtcaaaaagattatttcagtttttctattagttcagcctattctgttaactcttgttctgcttgatatttataaacattttagcttttc

SEQ ID NO: 64907 - DNA, 515 bp, Homo sapiens
tatatcacaacctaatacatatacacacacacacaaacaaagccaatatcaaaaaaagatacttttaccatgtgatatgtcattttctaaaggctcattatagccattaaattgacttctcaatacactaatgggtttcaatccccagtttgaaaaaaaaaatgcagttatctaggggcatagcatcagcaataaacaaggaaaagttggacacatccacatcttccatttaagatgaaaggtaatcaattagaaacatgactcagctcagactgggacagatacatgacaactatcatggcctggagcaggcatactgaaattgggacttcacaggtgaatttcagacagttgtgaagctcctaaaatattaaaggtatgtaaatttttcaaagtaatttattactcataaaattaaaacaaatgaacattaggtaagaagaaaacttacttaaatagtttagaataccaaaggaaccaaagtaaccagctatgttagcaccattaaaaaaaaa

SEQ ID NO: 64908 - DNA, 558 bp, Homo sapiens
cactgactccatcactggtgtctccatctggaatctgttttaagtaggagcatgtggattttcctattttagtgtcagttcaagttgctgtcacctgaccacccacccccagcccccgaccccagaccccactaccagattcagggcaggtacttttgtatgtgctctgttgaccttggatggaggtgataaggaccttatgacagtcatccatttggagacaggcttgtgtatcacttgagcttagtacaaaacacaatcaatcatgttccctagggggacttcttgagactcttggactaatgcggttgcctggtctgaaaacacttaagctgaagaaaaactgctgagactagatgcattctcaggaagtgaaagaaaattccagggggagtgccaaggtgaaagggaatgactaaagaccttcctgcttcctcatcaaaaggactgctctatgtcttcgaccgtcagcacacctgttttcctctctgctctggcttcagctcttctcacaggctttgaagatgttctcaagaatcacccacctttaaaatgaaa

SEQ ID NO: 64909 - DNA, 325 bp, Homo sapiens
agttggatttcagctactcagagtaattggaaaaggccacagcctggtgggcttcacagctttcagagacctggtaggggatggctaacaggttcttctgccaggagacaagtggcagacccaggtgtgaaacttttacaggtcccaccaagcctttcttatggagcacagagcataaggacaacttctgcagaaatggaatggggtacttggaaccaaaaatacatacacctcctttcccacctgcctccagcttagtagcccatagtcctctttgtccctcacactgagccaggcctgacttagatgatgaaatgcatggcct

SEQ ID NO: 64910 - DNA, 795 bp, Homo sapiens
tgcggaagtttcgttttttagctcgttgcaataaatcttgctgctgctaattcgttgggtctgtgctgcctttatgagcggtagcgctcaccgcaaaggtctgcagtttcacttctgaagtcagtgagactatgaacccaccagaagaaagaaacttagcgagactatgaacccaccagaaggaagaaactccggacacatctgaacatctgaaggaaaaaactgcggacacagcatctttaagaactgtaacagtcaccgcgagggtccgcggcttctttcttgaagtcagcgagacgaagaacccatcaattccggacacaccagtacctatgagtataatcttacttggaaataagagttttttgcagatgtaataaaattaaaatgaggtcatactggatgatggactgtaatccaataactattcttgtaagaagcgagaacattggacacagaaagaaggcggtcatgtgaagacagaagcagaaattggtttatgctgccacaaaccagggaatgctggggagtgcgaacaaccacagaaggcagaaaagacaagggaagatttcttcactggagaatttggagggagcatgatactgctgacaccttgaatcggcttgaatacattcaccagctgaaaaactagataagggggagaggtttaaattctccggaatcttcctgccttcaaggttcagccctgcgaaagataactaggaatttgtattttgggcgataacactttctctacttctaaaagacagaaactttttccacttttgtgagaaa

SEQ ID NO: 64911 - DNA, 498 bp, Homo sapiens
cttattacattcctcttgtggctggacacataggtcccattgcacaatatgactgttgaaaatgcttgtgaaatactgtttagtaaaattgcctaagatatttttcatatcagttcagtgaaaattattgtgaagtgtttatttacataatataatttatcattatctaattgttatatataataaataggactctactagaagagcatttttccaaaagctacagaaatgtcatttttgattatggtattaagcaaaatgttctctggttctttaattgtaataaaattattttttgtttttgtacacaattttaaaaagtttccttttccatatgttgcagtctacattctatgtttcatgcatttcttccctttgttactatagtgaaaagtttagggggcacataaatgaagctgttatttggagaaaaaaaatatgcatgagtatgcacataagatcacggcaggtataaactaggtttattgtaaatatgaa

SEQ ID NO: 64912 - DNA, 1862 bp, Homo sapiens
  misc_feature (371)..(371): n is a, c, g, or t
  misc_feature (522)..(522): n is a, c, g, or t
  misc_feature (525)..(525): n is a, c, g, or t
  misc_feature (533)..(533): n is a, c, g, or t
  misc_feature (710)..(710): n is a, c, g, or t
  misc_feature (1397)..(1397): n is a, c, g, or t
cacacacctccacacgcgcacatacacacacatgctgacaggtgtgcacatatgcgcacgtgcacacacaaatacgcacgcacagcacacacagacacataagtgtccataaacaacacagatctggcctcagagccaccctccaggtgcggctgccccgggccccaggtgcggctgcaccgtgctgtggtgacagccacagcaggatcagagcagcctcaaggcccttcaggagccggcagagctggccccaggctgagcttggggaggtgagcccaggcctgggaccgacgcttcctaattggcgggcagagtccatgcagcccctcccagtctacacggaagcccacgtgtccacctcctgcttctgntgtccccaggacagtgaaatttactaatgtggattaagaacatttttaaataaaaaaacattttacacattgaggacggaagagagaaattacggccaaccaaccccgtgcacttccccgcccaggttcatggagtctgagccctctggcntcntgagcctntgggctctgtcaccaggtgggcgccttccccagcccgtgaggctcgctgctcacgggggccccgatgcctgagtgatgtcatggatttaggtttcagtgctggcacatgtggcccgcagagctcagctcctctgtgagggacgtttcggctcctgtgggctttgctgtcccccatgntgactctgcctcacttggttgtcctcaggtcactctgtgcggtgtgcactgaccccagccagtggatgttccccgtccaagagcaaagctacagtcggctgcaggtgcagtgacttttgcacagtggaagaatttctccagaagatattcctgcaggtggaatcactggatcgtaggcccagatgtcttccacttacttgattttgcctgatgccttccaaggaggctgtgcacagcaggtgtgagatgccccatctcaccaaccggccaacatcccgatgggagatgttgagttttcaccacgctgctgagtgtgacgtggaatcttcttattttagcttgcatttccctgattacaagtcaggtggaacatctcgaatatgtttctgggccatttgattttcctgcaagtcacctgttccagttctttgcccatttcctgttgggttggtcaatattttttgtgattacacgttggatacgtggctggcctttggcttgcctttgacttcgtttgttctatcgaagcatgtgcagaattgttaaattttaatgtattcaaatgcattaatctcatttcttatttttgttgttttattttttgttttttgtttttttgagacagagtctcgctctgtctcccaggctggaatacagtgacacgatcttggctcactgcaacctctncctccccacttcaagcaatcctcctgcctcagcttcctgagaagctgggaccacaggcatgtgccatcatgtccggctaattttctttttaaaatgttgtagcaatggagcctgggctcaagccatcttcccacctcagcctgccaagtagctgggaccacagacatgtgccactgctgcgcccagctagcctttaatatttttaaatgctgtaagatctgcaggtttttttccaaccaagtttatagcttttcaccccacggatccccgaggccatgacaggcagtgacctccttggggcacccgcagagtcctcccccccatcttgggagggcttgtccagtttcagttttgtttgtttactaggctttgttttacagtcactagttaaatttactaagatttttcaacttcttgtctcaagggacttcattttaataaacaatatcttttctcttttctttc

SEQ ID NO: 64913 - DNA, 491 bp, Homo sapiens
tgagctcaatgctttggtgttgcccttttcagtcaagtacaattgtggctttaagatagcaggagaaattagacagagaataaaagaaaaaagaaaacaaaaaaaagaaaggaggaaaaggatgacatctcactcctgcctttgaagtggttacatatttaccagatgaattttgaaagaacaaattatgggtagtccaaaagccaaaggcaatgtgaggaaggacactccccagataagaacaaaaacagaaatctgtatgtgctatgtgttacacacagttgcgaataatcagatgtacacacatgatgcaaaggcacgccgctacacatttatgtgatattcagacatatgttcaaatagaggaggtgaatatctttttataaatacaatttagcaagtacaagaatgctgatcagctgcagctcaagaagaaagggggaaaaaatcttatggaaattattaatactccaagaacctctaagactcaa

SEQ ID NO: 64914 - DNA, 887 bp, Homo sapiens
  misc_feature (811)..(811): n is a, c, g, or t
ggattcctgtctcaggactcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacctgctgggtgcatggaatttggtagaaggaagatttatcctgagggttcaggccggggggganactttcagaaaaacgcgctggggtttgggcaccgagttgcaatcccttccggaaatagagggcgaccagggtccca

SEQ ID NO: 64915 - DNA, 1528 bp, Homo sapiens
ggattcctgtctcaggactcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64916 - DNA, 1640 bp, Homo sapiens
ttcagtgaggaggttatacccggaggtctcgacgctcgctcgtgctgctcgtgttgccgctgggtacgtttgctgccagtgctgatccagccggaggcgaagagaagcactttgggggcaaaagaatcttctgatggcatgctaacaattgtagatggcaactgtgttggaaactaggggatcccatctgagttggtcaaagtctgccaaaaagaaaaaagaaaaccaatatttaagagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64917 - DNA, 1527 bp, Homo sapiens
ggattcctgtctcaggactcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtgactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64918 - DNA, 1525 bp, Homo sapiens
ttcagtgaggaggttatacccggaggtctcgacgctcgctcgtgctgctcgtgttgccgctgggtacgtttgctgccagtgctgatccagccggaggcgaagagaagcactttgggggcaaaagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64919 - DNA, 720 bp, Homo sapiens
ggattcctgtctcaggactcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64920 - DNA, 1000 bp, Homo sapiens
cacaaccccatcataagtcgagaagcatctgtatagcatagtaattcagagcaaatttgaaattagatatttctagcaccagttacccccgtgattttatgcatggcattcctcaaaacatttcataaatgttttaaggaatatctgtgaaatatggataattatacctggctaataagactaagaagtaaaggtgacagtgtacataaagcatttgcacaatgcatggcacatagtgaacactcaatagtaggtattaatgtacttgggaatctaagttcaatatgtagaaaatactttttgtgaataaaattttaacttttatttttatgtaaacacatattgatgggaaaaaaaattcaaagagcacagatgagaacaaattaaacccttcccctaaccccacacatacccgtaaacctattaccctgcccctcagacccactcacagagataaccaagtttgcttaatttttaatcagatctttcttttctggataaacagatatacaatataactaactcaaaatctctttatattttagaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64921 - DNA, 539 bp, Homo sapiens
cctggaagcttgaagaccatggtgagaaaaaccagaagcttgaagaccatggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64922 - DNA, 510 bp, Homo sapiens
tagtaactgccaattcttttgttccttcgttaaaactgatgagcttctttttgtgactcaggtgagaaaaactggaagcttgaagaccatggtaagacattttttataaattctgggggcttacattttacaagatacctccctttacaggtgggaatattttcatatttactgaaaataattttgctgtagctatagtaactgccaattcttttgttccattgttaaaactgataagcttctttttgtaactcaggtgagaaaaaccagaagcttgaagaccatggtaagacatttatgtaaattctgggggcttacattttgcaatatatctccctttacatgtgggaacagggaagaatgtcgtggtaagaaaagtgggaggaaggcagagctcaccttagcttactggtttggtatattagagactctcctgggtttcaggtagaattctttagaaaaatgacatagcagctctgtttctcctgtctaacaatctttaggtcatcc

SEQ ID NO: 64923 - DNA, 1593 bp, Homo sapiens
ggattcctgtctcaggactcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtgactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64924 - DNA, 1553 bp, Homo sapiens
tcatcgctgtctggaacagcgatgactcgagagcgggtgctgctcgtgttgccgctgggtacgtttgctgccagtgctgatccagccggaggcgaagagaagcactttgggggcaaaagccaaaaagaaaaaagaaaaccaatatttaagagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64925 - DNA, 1520 bp, Homo sapiens
tcatcgctgtctggaacagcgatgactcgagagcgggtgctgctcgtgttgccgctgggtacgtttgctgccagtgctgatccagccggaggcgaagagaagcactttgggggcaaaagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttaaaaaaaaccagtatg

SEQ ID NO: 64926 - DNA, 1026 bp, Homo sapiens
tccatcagtcactatatgttaacgatctctgcctcctgcataacacgtcttggaagctcttctttgtctttctttcatcttgtctcctggggctcatttagagagtttgaggtaatacgggataccatatttggctctctgtctcccattaaattcattgtgtcaagagacgggaaatttctaacctgagtcctctatatgattatacacaaaaaggacacctagtttctgggcatggaccccaatatcgattattaaaaactcatttcttacagaacaggattttcaaactctttattcaaactttacatgactttcctcaaattggtccagtctattatgtagcaaaggggatgaggaggtagagcatgacccatgagtgcccttctacatgtcccacttgattcagtcatgacttgtttcatctctcccagcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatccc

SEQ ID NO: 64927 - DNA, 866 bp, Homo sapiens
gggccagtgaagctgaattcttgtttgacgttacttctagccctaaaaactgggctcaaagatctggtggccctggtaaggacatgaatatggtgaaactacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatccc

SEQ ID NO: 64928 - DNA, 367 bp, Homo sapiens
ataaataaataaaatatgaggacccaatttttttcccttgataagtgtgactttagctaattgatttcattcgatatatacctgtagcaatggtttccaaacctctctgatcataaaccacaataagaaatacattttacatggtgacttaacacacacacacacacacacacacacacacacacgcacacaggcacacacacacagagttatgtttttaaaaactgaaacagaagctaacaaaacgacaattgcactttccaaggatgcaatagttttcaattttatttgatttaaaaacaagtgctagctgagtgatgcgtgcttgtagtatgagctacttgggaggctaagatgggaggatcac

SEQ ID NO: 64929 - DNA, 2372 bp, Homo sapiens
  misc_feature (1)..(1): n is a, c, g, or t
  misc_feature (5)..(5): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (19)..(20): n is a, c, g, or t
  misc_feature (22)..(23): n is a, c, g, or t
  misc_feature (26)..(26): n is a, c, g, or t
  misc_feature (28)..(28): n is a, c, g, or t
  misc_feature (34)..(34): n is a, c, g, or t
  misc_feature (37)..(37): n is a, c, g, or t
  misc_feature (55)..(55): n is a, c, g, or t
  misc_feature (68)..(68): n is a, c, g, or t
nttcngggcngcnncncgnngnnggngngggcgnctngggctcggggggcgcggncccccaacccganccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaggcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccgtgggtccccctctcgcctggctggttcggtctaacgccccggagagtcagggctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtagccaggctgctccaagacagtggatatcgaggcagtcgtgaggcccctactccacctgggagcaggggaaggacgtggttgcctggcctgggctgcgcccagcagcttccccccaatcctgccctcccagctgtcgacccagatgggatgttcggatcggtttgtaattaaacctgggaatggccacaagaaaaaaaaaaaa

SEQ ID NO: 64930 - DNA, 379 bp, Homo sapiens
ggtggcttctgcgaagtgtgcaagaagctggtgggttatttggatcgcaacctggactttaacacgcgcacgcaggtgggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggtgaggccagggatgggggtggacctgcagccctgccgcccccctccggccgcgagaccctctcat

SEQ ID NO: 64931 - DNA, 1758 bp, Homo sapiens
atgctgctttctgcctggggacacgcccacccctgtttgacaatgaggggactgacactcagaggagagccttagagtggcctgtcggatgttggcattgttggaagccgttagaaaacccagggcagaacattttaacgctaggggcaagagaggggtgccggctgtcgtcttgagtatttagggcacattggaggccccgcggccaatgcagtaagaccagacaaggaaacgagaggcgtacgctttgggaaggaagcccacctgacaaggcaggaaaaagaaataggagttaacctctgaaagaaagagctgctgttaccctttgtacatgcttagtacgtgcctagaaaacccaacctggggagtccaggttgctacacatgtgagcccaccgcacgcacggggctgggcagagtgcgagtctgatacactgtgggtgctcggtcagcgcaggccgacgggtgcatgagggactccctggggaacccgtttctcccagctctggtcccggcaggagtagctgcttgccccctgcctgcccagcactcctgtccctggcctgcaggaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccgtgggtccccctctcgcctggctggttcggtctaacgccccggagagtcagggctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtagccaggctgctccaagacagtggatatcgaggcagtcgtgaggcccctactccacctgggagcaggggaaggacgtggttgcctggcctgggctgcgcccagcagcttccccccaatcctgccctcccagctgtcgacccagatgggatgttcggatcggtttgtaattaaacctgggaatggccacaagaaaaaaaaaaaa

SEQ ID NO: 64932 - DNA, 991 bp, Homo sapiens
  misc_feature (1)..(1): n is a, c, g, or t
  misc_feature (5)..(5): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (19)..(20): n is a, c, g, or t
  misc_feature (22)..(23): n is a, c, g, or t
  misc_feature (26)..(26): n is a, c, g, or t
  misc_feature (28)..(28): n is a, c, g, or t
  misc_feature (34)..(34): n is a, c, g, or t
  misc_feature (37)..(37): n is a, c, g, or t
  misc_feature (55)..(55): n is a, c, g, or t
  misc_feature (68)..(68): n is a, c, g, or t
nttcngggcngcnncncgnngnnggngngggcgnctngggctcggggggcgcggncccccaacccganccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacacttccccccaatcctgccctcccagctgtcgacccagatgggatgttcggatcggtttgtaattaaacctgggaatggccacaagaaaaaaaaaaaa

SEQ ID NO: 64933 - DNA, 477 bp, Homo sapiens
accctgtgcccacatccactgccccatctctctgcattgctggggtgggcagctgggaatcccggtggggggcccaggcaggtccagctggcccctccccgcccccaggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggattggggaggactaagcaagctgactccccggtgtgcctgaggctgtcagccctgctgctacaaccaatatccctcctccagacgcgcggccggctcccgcaatgggcagaaaacggcctccgtctcaccgcagaacatgtgtaaagggggggacgtgtctgtgtgctggtaacacgttttttatagac

SEQ ID NO: 64934 - DNA, 2631 bp, Homo sapiens
  misc_feature (1)..(1): n is a, c, g, or t
  misc_feature (5)..(5): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (19)..(20): n is a, c, g, or t
  misc_feature (22)..(23): n is a, c, g, or t
  misc_feature (26)..(26): n is a, c, g, or t
  misc_feature (28)..(28): n is a, c, g, or t
  misc_feature (34)..(34): n is a, c, g, or t
  misc_feature (37)..(37): n is a, c, g, or t
  misc_feature (55)..(55): n is a, c, g, or t
  misc_feature (68)..(68): n is a, c, g, or t
nttcngggcngcnncncgnngnnggngngggcgnctngggctcggggggcgcggncccccaacccganccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagctcctgccaccactcaggctgcagacaggatctcgacacggaccccgcgtcaggctcagggcctcctgctcgctgctccaacccccacatctgatgccgagccttccttgtgggccgaggccagggacacactggtccctgggaaagagggtggtagaggggccagagctgggggccgggcctctgccggatgcaaggacgcacgtggagtgggctggtgcccaagctgcacctgtcctgtggggcactcctcccccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaggcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccgtgggtccccctctcgcctggctggttcggtctaacgccccggagagtcagggctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtagccaggctgctccaagacagtggatatcgaggcagtcgtgaggcccctactccacctgggagcaggggaaggacgtggttgcctggcctgggctgcgcccagcagcttccccccaatcctgccctcccagctgtcgacccagatgggatgttcggatcggtttgtaattaaacctgggaatggccacaagaaaaaaaaaaaa

SEQ ID NO: 64935 - DNA, 1942 bp, Homo sapiens
  misc_feature (1)..(1): n is a, c, g, or t
  misc_feature (5)..(5): n is a, c, g, or t
  misc_feature (10)..(10): n is a, c, g, or t
  misc_feature (13)..(14): n is a, c, g, or t
  misc_feature (16)..(16): n is a, c, g, or t
  misc_feature (19)..(20): n is a, c, g, or t
  misc_feature (22)..(23): n is a, c, g, or t
  misc_feature (26)..(26): n is a, c, g, or t
  misc_feature (28)..(28): n is a, c, g, or t
  misc_feature (34)..(34): n is a, c, g, or t
  misc_feature (37)..(37): n is a, c, g, or t
  misc_feature (55)..(55): n is a, c, g, or t
  misc_feature (68)..(68): n is a, c, g, or t
nttcngggcngcnncncgnngnnggngngggcgnctngggctcggggggcgcggncccccaacccganccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctgcgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaggcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccggctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcctcacttaggcaaatgcaattcggcgttcagttacatgtttgcataagcacccgcagacagtgttctgggaatccgggtct

SEQ ID NO: 64936 - DNA, 265 bp, Homo sapiens
cacatttcaaagggtcatttattattcaatggatttattttcacgagttattttctgaatttcctagccgcactcaaaacataattaaacttacaaaaatgctgtatgcacacaatttatcaggaatatctactctctgaaataagtacagcacaaatgagttttcttaagtcaagaaaactgtatcattgtatttacatatatattcaccactaaggaaaattaaattaattgcctggatacttcacagcagggcagccactag

SEQ ID NO: 64937 - DNA, 2639 bp, Homo sapiens
  misc_feature (1)..(1): n is a, c, g, or t
  misc_feature (5)..(7): n is a, c, g, or t
ngccnnngcgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgc

SEQ ID NO: 64938 - DNA, 2674 bp, Homo sapiens
  misc_feature (1)..(1): n is a, c, g, or t
  misc_feature (5)..(7): n is a, c, g, or t
ngccnnngcgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggtgagaggtgccaacagaggcctgtgtcaaaggaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgc

SEQ ID NO: 64939 - DNA, 2419 bp, Homo sapiens
  misc_feature (1)..(1): n is a, c, g, or t
  misc_feature (5)..(7): n is a, c, g, or t
ngccnnngcgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgc

SEQ ID NO: 64940 - DNA, 2593 bp, Homo sapiens
  misc_feature (1)..(1): n is a, c, g, or t
  misc_feature (5)..(7): n is a, c, g, or t
ngccnnngcgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgc

SEQ ID NO: 64941 - DNA, 2668 bp, Homo sapiens
  misc_feature (323)..(323): n is a, c, g, or t
  misc_feature (724)..(724): n is a, c, g, or t
  misc_feature (2022)..(2022): n is a, c, g, or t
aagttttgttcttttgctctttgcaaaagctcttgctactgctcattctttgggttcatactgcctttatgagcagtaacactgatcacgaaggtctgtagcttcactgctgaagccagcaagaccacaaacccactgggaggaatgaacaactccagacctgctgccttaggagttctaatgctcaccgtggaggtttgcagcttcactcctgaggccagcaagaccacgaacccaccagaaggaagaaactctgaacacatctgaacatcagaaggaacaaactctgaacacgctgcctttaagaactgtaacactcaccncgagggtccaaggcttcattgttgaagaaagaaacataattacgtgtggaaaagcaggaactcaggtggggtaagaaaccaatcgtgatgaatgagggcttgaactctcattgtctgagacgggatttcaccgtgttagccgggatggtctcgatctcctgacctcgtgatccacccgcctcggcctcccaaagtgctgggattacaggcgtgagccactgcgcgcgcgcccggccccttaccgttcttggaatagtgaggaaatcaagagatggagaaattggcccaccaaccactttggtggtaaaagaggagagtttcctttgtgattggcccgcgctcctaaatttgcccaagtaaaatctacatgagtgtttcccacgacttggaggtggattgcntatgaggcatttagggcataccccataactccaattgcctcactagtagacatttcccagtcaaataagatatggcctgaggaaacggcccaacagtctcactctgtcacccagactggagtgcattggcatcatcatggcttactgcagcctcaacctcctgggctcaggtgatcttcccaccacagcctcacaggcagcttagactacaagtgtgtgccatcatgcccagctaatttgttgtgttttttgtagagacagggttttgccatgtcaccaggctggtctcaaactcctggactcaagagaccaacctgccttggcctcccaaagtgctgggattacagctgtgagccactatgcctggcctcttatttttgtttcttattcatattatctaagaattttaatttactgtcagtggttattgctttatgaaatctcagtaacaagaagcaaagaaaatgagatcagtaagtgagaatcctgaatacattacgaacttttctgctcataagtcctcttgtttgaacaaacaggaagcattatcatgaaagtctcttctgataattccactgccattcttacatctatcaatgattgaaataaagtataaaaaatgagactaaccgatgactaataggatagtagaagacccttaaaatagttttattcctctagtacaggtggtcttaaatgggggtcttaaaaaaatgattctaattctcaagatttctagaaatgcttcctaaaaagtaacctttacattatatccttcaaattaaaagcaaagtgccttaacagcgaagtaaaatcatgttccataggaataaatttcctccactcattatgaatacaggtatcagaaagattaaaatttacttctttctgtcattgacacaactactctgcttattcttgcttagttatttcagtacccatgacagtgttccagcacatagctgagtatgtgggacaaattcagaacacagaaattattatattaatgcatgaataaatgaatgaatagttgaagtgtaagttcctaggaagaaaggcaatgagataaatccactttttttccctcacataggccttgtttgaagacaataattacatggcctgaggccctctctttgagaatacttcatttttactcaaagaggtcttacctagtatgtaaacctcatttgtttgatccatttaacttcatcatttgggagatataatggttctcagacttgtaatattttgacggcatgaaacaaataatatttgatttgttacatctgaaggantataaggctaatgagtaagaataactcgatgctccacttcaggtgattcgtatgctataggagttagcaatctagttcttgtctttcgtttgaataaattaacaaatattcctagagtatctactgattacaaggcctgagccagacggaccttgttagggactcttgaacaagcagaactaaaagcatgatagacaaaaggtagaaatctaattaaaagcagttgagatgatgacacaagatcaattgaaataatctgcaaagcccagaatgaagttagacacttttcattttagtctgctgacaaaattaagcaatataacatcacaaaatattagatttgttaattatatatttgtctattttatgcttaagtgtatctacattaaatgttagattaaatgcaatgtggtgttagtattagaccctggagtaaagtcataggtgaaaaaccagtgaaagcaaatagtctgtagtttagttaataatattctagcaatattaatttttttagttttgaaaaatggttataaaagatgttaacattcgggcaaactggataaagattacatggaatctcttttggctatttttgtaacttctgtaaattaaaaagtacttcaaaataaaattatttaaaattgta

SEQ ID NO: 64942 - DNA, 300 bp, Homo sapiens
taacttaaccactcagtcattgctgaaacagttgtcatggaggcctgcctgttcagctgttagtgagacctggcctgccacaccttctcactgaagtctttcttaaacatgcactttaaaatttcaccctcttattttgctatataatgttctccttctctgttatattttctttttcttcttacaattatcactgtttaacttacagtatattttatttggttatattatttattgtctgaatctcccagcagaaggtaagttccgtgagggcaggggattttgtctgttttatcctct

SEQ ID NO: 64943 - DNA, 348 bp, Homo sapiens
  misc_feature (322)..(322): n is a, c, g, or t
aaacaaaatgtgcaattcctttgatgatacagggtagaagactacagctggagtaacttgagttttgtacctactctgctggcgaaaacattaagttaaagaagggagaagagagaaacagactggttctgcctctttctgtgtttcttaaggggtcttttgagaaggatgatgaaatgaatatgggtatatagaaatattaaaggaggtggtaattaagaggatcaatttatgtaagaaggatcctaataaagataagaaaatagctgataaaatattgatacgggcaaggcattctacttcattacatttaatgttgggngtttcaatatagcttaatggttcaga

SEQ ID NO: 64944 - DNA, 439 bp, Homo sapiens
acggaggctgagaagggaggatccactgagcccaggagtttgagaccagcccacagagaaacctcatcttaaaaacaaaacaaaaaaagaaaaaaaaaaccagcaatttttgaaaacattattgtggaaatcagatactcttgctagcaggtttaggtttgttttggtctgaaaaaggaaaatatgaagacacaagaaaggcttagtttggattcctttaaacattcttatctttttaaaaggagaattgtccaattaaagttggaaaaattacaaggtacaattatatatccttctgctgagcgtgagacctccttctgtccgctgcggatttcccctagatgctgtcatccctgattgtggatcacaagtcctagcggttcactttgattcagagcctcaactcaccaggcgttgaaatctgccaccatccagctct

SEQ ID NO: 64945 - DNA, 694 bp, Homo sapiens
  misc_feature (218)..(218): n is a, c, g, or t
tttccttaacatttatcttgcaaatcacagcttagatatcttcctgtttgttattattacctgtcacgttatatcgtgaacacaaacacacatgaatttacttgagagtaaagtttgtgtcttatttttttctgtaactgggcttcttaccacaaggccttggcatgtaacaggtactcaaaggtatgttgaattgaattgaagcatagcttataagnatgaaggtaagggctgtaacaagcaatttaaatagtccaggtcttagaaaacagtcttttttttttaatgtttaccagtttattataagggatatgtttttattgccatcatctctggaaaaccaaccttcttaggagagcttaatatcctttccctaccctagtttctatttgtgttagtaatcgtgctctgggaaggggaaattgccaacagtctggcaagcctccctagagagccctttcaagtactctggagaaaacagcgatgccatgtgctgctgctggggaagggaagcagcagcactggggagcaagaaaccctagagctcttctccttggccttgttaaatgtgcttgtttgttgggatgatgcactggctttagagagaagatcaatggcctgaggcagctctagaggcttatttctgttaaactgcttttattctttaatcttacatatagtcacagtatccttt

SEQ ID NO: 64946 - DNA, 1448 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64947 - DNA, 597 bp, Homo sapiens
aggaggaaagaagttgctctagagtagggctgtggcaagcagtaaatggtattgtttttgatacattgaacactgctttccaaagtgaatattttctatttgatgagctaattttaaagtaattattttttcttgcttaccaggaattttctacttctggtcatgcttacactgatacagggaaagcatcaggcaacctagaaaccaaatataaggtctgtaactatggacttaccttcacccagaaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64948 - DNA, 1009 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaaacagatgccaattatggttacacattaagtaatcaataaagaaaacttccatagctaacacacaacacaggaaaccagcaaagcaccacacaacaccaaacaccacagacaccacgccacaaccagaagacgaaacagcaagagcgaaaataacagagagagggagaagaaaaagcgagagacaagagacgcacgaccaactctcgctcgggcgcaacagctctcgaacaacagggagaaacagagcgcacccaacggagggggcaaaaagacaaagccggaccgacacccccc

SEQ ID NO: 64949 - DNA, 595 bp, Homo sapiens
gtatataatttttttattatacccttactgcaccatcaacaaacttcaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataagaacataactgctcatgtg

SEQ ID NO: 64950 - DNA, 1362 bp, Homo sapiens
ctgaaagagtcctgggattcagttatgtaggctgcaccatgttggtgggatgaatcagaacttttacgtagtattttatgttgagcctactggacactgctactataccaggaagaaaaagcaaagggcaaactatgtgtttttaaactgttgcagattcctctctgctagatgctctaatttacttatgatggctaaaacaaaggcaagcagtggtatagacagttactgaaattgatgaaacagtattatcaggaaaaccatgtgaaaacccaaggactcacctctggcatgcttggaagcaataactaaggtggttttctggagcagtgcaccctaggtatcgtaggagggtgctttctaactgtaggattgtgttttaaaggaaatccagaattggttttattcctatacctctacctttttatttttttgcagaatctttattgaactctactttgaagtttctaagttctatgaacttctcagagacctatagattatacttacccgaggtgtctgcctttgtgcttaattgaattgtctaagaaactcacatcatgtggaggagccaagtaaatggatcaagtgttaacgttttaattaagcagtcattactggcatagctggatttagttctgtgttttgtttagtagtcatttatgctagaaatttgctgaaatctatagttacaaaatgggatccttgtttagatagtcttagaatttgttttcataccataataacaatggtacaaactagatatttatgacgttttcttatctatgaaaacaggaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgtaagaatgtgctgccagattggatctgctcttatgtttgtgtctaagttttcagagaatgttgtgatatgagtgtagtttgcttgttctttattaattttaataagccagctcattgtgtagtgaaaggaatataatgtggccaggctcacgcctgtattcccagcactttgggaggccaaggtgcatgaatcacctgaggtcaggagttcaagaccagcctagccaacaaggtgaaaccctgtctttactaaaaatacaaaaattaggtgggcgtggtaggtgacgcctgtagtcccagctactagggaggctgaggcaggagaattgcttgaaccctgcagatggagaggttgcagtgagccaagatcacaccattgcactccagcctgggtgacagagcgagagcctatctc

SEQ ID NO: 64951 - DNA, 1846 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataaaaaaaaaaaaaaaaaaaaaaaaaaaaaaaaacaaaaaaaaaaaaaaaaaaaaaaaaaaaaggggggggggggtaaaaaaaaatcgaggggggatagcccctttttttaagggggcccaaggggggtaaataagcaggccgccggggccctaaaaacactggtagaggaaaaccgaccacgtgggtatcggtgagaaccccctgcggggtggctaagtgggcacccaccccgcgataagaccgaagaaaaaaacaggagtggggggaaaccggtcttgcgtgcaaagtgtcgcttttgatacccgcctatccatcaacggcagcggcatgatacgactaatgcgcgaatgggaccagcagaacaggaccccgaccaacatcgtgcaccttctcttccca

SEQ ID NO: 64952 - DNA, 1313 bp, Homo sapiens
aggaggaaagaagttgctctagagtagggctgtggcaagcagtaaatggtattgtttttgatacattgaacactgctttccaaagtgaatattttctatttgatgagctaattttaaagtaattattttttcttgcttaccaggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64953 - DNA, 1483 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataaggcctcgttggcctcagcggtggagctctgtgccg

SEQ ID NO: 64954 - DNA, 1122 bp, Homo sapiens
tgtagggtcagatggagacagcccagaaggaaagccagctctatccacccctacagcttccccggcaaaccaggttcaaagcccatcagttatatctcactgtgccgctgtcaatgcatgttgtggctgctggcaaagagttggtttggcctccacagaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64955 - DNA, 1531 bp, Homo sapiens
ctgaaagagtcctgggattcagttatgtaggctgcaccatgttggtgggatgaatcagaacttttacgtagtattttatgttgagcctactggacactgctactataccaggaagaaaaagcaaagggcaaactatgtgtttttaaactgttgcagattcctctctgctagatgctctaatttacttatgatggctaaaacaaaggcaagcagtggtatagacagttactgaaattgatgaaacagtattatcaggaaaaccatgtgaaaacccaaggactcacctctggcatgcttggaagcaataactaaggtggttttctggagcagtgcaccctaggtatcgtaggagggtgctttctaactgtaggattgtgttttaaaggaaatccagaattggttttattcctatacctctacctttttatttttttgcagaatctttattgaactctactttgaagtttctaagttctatgaacttctcagagacctatagattatacttacccgaggtgtctgcctttgtgcttaattgaattgtctaagaaactcacatcatgtggaggagccaagtaaatggatcaagtgttaacgttttaattaagcagtcattactggcatagctggatttagttctgtgttttgtttagtagtcatttatgctagaaatttgctgaaatctatagttacaaaatgggatccttgtttagatagtcttagaatttgttttcataccataataacaatggtacaaactagatatttatgacgttttcttatctatgaaaacaggaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64956 - DNA, 1389 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaatctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64957 - DNA, 1642 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggtaagtaaaggaattagtaacagaggggttgaggtggaaggtgatagagaaaacaatgaaaataacctgcagaacaacctgtagtcactgtaagttgatttggaccattctgtaacatttggttgttcagacagaaaacaatacagatcaaatacttttgcattaaaaaagtatgtatttctgactataatgtggtcactttggcctttgagtttggttgatcactcattgcccttaaccctgaacttcagagaaagtttgccatgatcatgctttcctcattacacatcagatagttataaataaccgattgagtaatagctgtttgcttatagctcgtatacccagctacaatccacaccattgattccatctgttgtttctagaaagttcagatctaattgtaatacttgtttcaagtgattgtggtgttttcttcttcctaggagtcaaattgactttatcagctttaatcgatgggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64958 - DNA, 1590 bp, Homo sapiens
tcagctggtatctcagagaattcagggtgtttggttgtgtagtgtttaaaaattttgcttgaggccttgaagcatgcattctcagggtacgtcctacccctacaagtcctactgacttcttaatcagtaattccggctgggcacggtgggtcacgcctgtaatcccagcactttgggaggctgaggcaggggatcacctgaggtcaggagtttgagaccagcctggccaacatggtgaaaccccgtctctactaaaaatacaaaattagccgggcatgggggcgcatgcctgtaatcccagctacttgggaggctgaggcaggagaatggcttggacccgggaagcggaggttgcagtgagccgagatcgtgccatcgcactgcagcctgggtgacaagaacaaaacttcatctcaaaaaaaaaaaaaaaaaaaatcagtaattctagattggccctagggtgcttttagcattggaaacctaatgcacaaagtgatggttatattggactgatctgtaattcactgttttctgttattattctatctcttaatcttaggctaaagtaaataatgccagcctgattggactgggttatactcagacccttcgaccaggtaagtaaaggaattagtaacagaggggttgaggtggaaggtgatagagaaaacaatgaaaataacctgcagaacaacctgtagtcactgtaagttgatttggaccattctgtaacatttggttgttcagacagaaaacaatacagatcaaatacttttgcattaaaaaagtatgtatttctgactataatgtggtcactttggcctttgagtttggttgatcactcattgcccttaaccctgaacttcagagaaagtttgccatgatcatgctttcctcattacacatcagatagttataaataaccgattgagtaatagctgtttgcttatagctcgtatacccagctacaatccacaccattgattccatctgttgtttctagaaagttcagatctaattgtaatacttgtttcaagtgattgtggtgttttcttcttcctaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64959 - DNA, 1279 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgtaagaatgtgctgccagattggatctgctcttatgtttgtgtctaagttttcagagaatgttgtgatatgagtgtagtttgcttgttctttattaattttaataagccagctcattgtgtagtgaaaggaatataatgtggccaggctcacgcctgtattcccagcactttgggaggccaaggtgcatgaatcacctgaggtcaggagttcaagaccagcctagccaacaaggtgaaaccctgtctttactaaaaatacaaaaattaggtgggcgtggtaggtgacgcctgtagtcccagctactagggaggctgaggcaggagaattgcttgaaccctgcagatggagaggttgcagtgagccaagatcacaccattgcactccagcctgggtgacagagcgagagcctatctc

SEQ ID NO: 64960 - DNA, 806 bp, Homo sapiens
cggcgagaagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64961 - DNA, 562 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacggaagtcgagagtacggaagtcgagagtacggaagtcgagagt

SEQ ID NO: 64962 - DNA, 695 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64963 - DNA, 531 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagcaagagtggaaaggaacgtgtcgacgcggccgcgaatttagta

SEQ ID NO: 64964 - DNA, 1240 bp, Homo sapiens
ttgtgtgtgtgtgtgtataggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64965 - DNA, 1265 bp, Homo sapiens
taagagcctgagagagatttttctaagatatgtgtaacacaccaacgtactgtgacctaggaaaggctgctaaggatgtcttcaacaaaggatatggctttggcatggtcaagatagacctgactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64966 - DNA, 1894 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggtaagtaaaggaattagtaacagaggggttgaggtggaaggtgatagagaaaacaatgaaaataacctgcagaacaacctgtagtcactgtaagttgatttggaccattctgtaacatttggttgttcagacagaaaacaatacagatcaaatacttttgcattaaaaaagtatgtatttctgactataatgtggtcactttggcctttgagtttggttgatcactcattgcccttaaccctgaacttcagagaaagtttgccatgatcatgctttcctcattacacatcagatagttataaataaccgattgagtaatagctgtttgcttatagctcgtatacccagctacaatccacaccattgattccatctgttgtttctagaaagttcagatctaattgtaatacttgtttcaagtgattgtggtgttttcttcttcctaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64967 - DNA, 939 bp, Homo sapiens
aagcagtagaggcggtgtgaatcggcagagggtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 64968 - DNA, 1443 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctgcactacattcacattgggtccctatgggccgacatgtgccttgatgtccaaaattagtggagtagggtccagttagtgttaaaagcacacgtaatcctccacgccctttagtgggtccctgccccatccgtaaagagggggacgcagggacccaccaggggaagggggcatgccggtttcccgaatcaatttggtttgggcgtgtgaataaaagagtccccagtccccagggtagccccttgtgggcctagccggtttgggtcccctggttgaagatgacgtcttgtatgtgcccccccccctttttgtaacggggtgggattttggttattgaggtatagtgcctttgggggttaaggtttttaataaaatccaattaccccttcacataagaaaa

SEQ ID NO: 64969 - DNA, 974 bp, Homo sapiens
cggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgtgagtgtttataatttattccttagtatcagtgcagttgcccaaaatattgtagccattagcatgctgagaagtgatggtactcagatttagcatgccttggtgaatatccatccttgcggtgctatcctcatagcaaaaccttgccaggaggctggtgcacgtggtgtgcaggctgtgctgctggtggtcactggcccctcagcctgcaccccaaacttgaggaagctccagcctctgtagaagaaccactgggatagag

SEQ ID NO: 64970 - DNA, 910 bp, Homo sapiens
ggtgatttggaaaaccagaacaggaagtgtaacttacaggatttccaaaatcacctgtgaatgaagtggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaaaaaacaaagaaaagaatagaaaaaaaaaaaaaagggggggggaaaaattccggggggcattcgacactttgaaaggggcataaggggtataaaaagggggggggaacaggggaaaggtggttgggaacattgggtgtggacccgaaaagggaaagatggggctggtgttagaaagac

SEQ ID NO: 64971 - DNA, 558 bp, Homo sapiens
gtgagtttgtttaaaggtgaattttcaatagatttattattattgtctccaaatattgtgaggcaatttaaatgtgtctttattcattatttttctttagaacttttctttatggaaaaggtggcaaaaatcattattcttagaagtaaagtagcaattacattaatgaaacacaaggatatgtcacgtttaacatggagcgctggagaggaccagaaccacctatcctcaatctttgttctctgcccttagccctaacagctgcagccggaaggggcaaactggaggtgtgccgtttgctcttggaacaaggggcggcagtggcccagccaaaccgccgaggagcagtgccactattcagcacagtgcgccagggccactggcaggtaagcagggcgaccacttccagtccctcaggcaggactgagttctaggtgaggacttctgatgcacagagcaaaatgatcacaagtaaagtttgggttacccagcagtgatcaggtttgaggacttggacctttgttatgagtattctggttaattgagaatacgacagtt

SEQ ID NO: 64972 - DNA, 675 bp, Homo sapiens
  misc_feature (166)..(166): n is a, c, g, or t
agggatttaggattgcgaaatgttgagaagctagataggtcggggttgttcggtattaagacaggtggagaaaggggaatgtggtgcaaggtgattagttgcggtaaggatacgggtttcataagtcacgaagttgtaaagggcgcgctagtgaattgtattttgnttttttaaaacgactggaatctgttttattgaaagcttataggatgaacttttaacagttgagatacaactggcataccagcatcagtcttaaaatggaaatagtccagaaacgagcagtgttctttgcaggagcatgccccttcagcgtacttcccctcctgctgtgtgattccatgtctcctcagccctgtgctatcacttgcctttgcaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtaagtacctttaaacaagcctcaagagagcagagagaggggctattctccatccatactacctggggttgaaagtggagtgatgtattgatgattcctgatacagagctctcagatcta

SEQ ID NO: 64973 - DNA, 8893 bp, Homo sapiens
  misc_feature (772)..(772): n is a, c, g, or t
  misc_feature (872)..(872): n is a, c, g, or t
  misc_feature (911)..(911): n is a, c, g, or t
  misc_feature (917)..(917): n is a, c, g, or t
  misc_feature (3770)..(3770): n is a, c, g, or t
  misc_feature (3948)..(3948): n is a, c, g, or t
  misc_feature (4169)..(4169): n is a, c, g, or t
  misc_feature (4202)..(4202): n is a, c, g, or t
gtgagtttgtttaaaggtgaattttcaatagatttattattattgtctccaaatattgtgaggcaatttaaatgtgtctttattcattatttttctttagaacttttctttatggaaaaggtggcaaaaatcattattcttagaagtaaagtagcaattacattaatgaaacacaaggatatgtcacgtttaacatggagcgctggagaggaccagaaccacctatcctcaatctttgttctctgcccttagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccngaacacttctgttgttgtcactcttctgaagaaaggagccaagataggttgtcagacgttccgagtcgcccacgaggtccagccacatgggcgatggccncctccaagccagacatcatgatcatcctgttgagcaagntgatgnaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatatanttatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctnctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgntctagtggccctcttcctgtaaacccagatggngtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccaggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaaa

SEQ ID NO: 64974 - DNA, 9228 bp, Homo sapiens
  misc_feature (3746)..(3746): n is a, c, g, or t
  misc_feature (3846)..(3846): n is a, c, g, or t
  misc_feature (3885)..(3885): n is a, c, g, or t
  misc_feature (3891)..(3891): n is a, c, g, or t
  misc_feature (6744)..(6744): n is a, c, g, or t
  misc_feature (6922)..(6922): n is a, c, g, or t
  misc_feature (7143)..(7143): n is a, c, g, or t
  misc_feature (7176)..(7176): n is a, c, g, or t
gtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccngaacacttctgttgttgtcactcttctgaagaaaggagccaagataggttgtcagacgttccgagtcgcccacgaggtccagccacatgggcgatggccncctccaagccagacatcatgatcatcctgttgagcaagntgatgnaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatatanttatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctnctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgntctagtggccctcttcctgtaaacccagatggngtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaagaggaagaagaaggagaaagaagaagaagaagaagaactaagaagaactaagaagaaggagaagaagagggagagaagaaagaagaaaaggagaaggaagaagaagaactaagaagaaggaggaagaaagaaggagaaggaagaagagagaaggagaaggaagaaggagaggagaagaaggaagaaggagaaggaagaggaggaagaactaaagaaggagaaggaagaggaagaagg

SEQ ID NO: 64975 - DNA, 3597 bp, Homo sapiens
gtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacaggtacctctcatggacgttgccctcaagaatgtgttgtgtttgtgtggactctcgaatctcacccccttattttttccctggcatacatttggcagtcttctgtctcaggcttttgtaatgcagactgattcagccaaactaaacagtcaagcagttttcctctttcaatcctctttgcctgtggattctccatactctttgcaccagagtcttctttcaaacaaaactttttccctctcttgtttccaaatatttttaaaagactgaaagttaccttacaatgtgccaaaccagagcagaaaattattgtggcctgtctcctttttatgtgatccttgtagtagttaggaataaatatttctcccatcaaa

SEQ ID NO: 64976 - DNA, 3532 bp, Homo sapiens
gtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcaggtaagcagggcgaccacttccagtccctcaggcaggactgagttctaggtgaggacttctgatgcacagagcaaaatgatcacaagtaaagtttgggttacccagcagtgatcaggtttgaggacttggacctttgttatgagtattctggttaattgagaatacgacagtt

SEQ ID NO: 64977 - DNA, 714 bp, Homo sapiens
ttctgcaatttacagtatcaattagctctagctcgcctgtgttgcttatctgtatagaatcaacattcgcagttgcattatttctgaataagcctaggatgccatcatatgataactcaagtccctaaaccacactgcattttttctctctttgtttctctcaatgttgacagtttgacctaagttctgcattctcttgttcctttcagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacgtacgtattcctttttaaagaactccctgtttcattggcgctgaagtttttctgacatatttatattaggtcgtatatccttttattttctcatctgcaaaacctgacttccacgtgaggactattcatttaggttgagagaaagattgtaatactctatttacatctaacccacatacccagtagtcacctaagcgtgactgaagaaaaacctttctcgtgg

SEQ ID NO: 64978 - DNA, 488 bp, Homo sapiens
ttggaatccagttgggaagtcagggtccagggccttccatttgccaaggctttgcctccctggcttgtatcttgggtatcccctcaaccttgcctttcctgccaggtgagtttcctatagaaaagactagacccttctgccctcaccatcagggccagaactcctctctaggctggcgtttgggagggttagcccttagtaacagctgctgagaagaagaagggagtggggaccacacttcctcagctgttcagcagaccaactgtgtgtttcgccatcttgtgctcccattagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgtaagtccctgtcaccccaactcctttctgcaatcctggtagctgat

SEQ ID NO: 64979 - DNA, 5659 bp, Homo sapiens
gtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgaggtaagaagtaggcaataggattgttttttcaagctctgtattgaaggacccaggaaaccaggagaaaagattgcacgaagacaaaattgccaaccaaattaatgtgaattcgtgatcgctgctctgaataataaggagattaaactccatgaagcactttactcaaatgccaaagtccctcaaattataggtatagaaaggtgcgagttggaaaggaccgtggaaatgatataattattctccatgttttcctccctgtttaacagacagtggcaccaaggctcaaagagatgaattattgaggtgtagtcacatggttagataatgtggcacaggaacagcataacatttagaatctcagaaggaccagatttgagtcccagcctcgctattcattaactctagcccttgaacaatttacctatctcttagaagtttagtttcccatcagcaaagtgaagctaataaactcctttatacaaggctgttgtaagggatgcttggtaaactgttaaacattatacagtttatttattaatgataataacaataatagtggcaaatgtagggaattggtagtgtgctaggaaatgtttaacaaccaactgtgaagaggggtgtggggtggaacaggggtgtgtgtttgtgtgtgcatacgtttattataaattttactgatagaatgtgttgccgtggaatactacacagccgtaagaagaacaaaatcatgtcctttgcagcaacatagatgcaactgaaggccagtatcctaagtgaattaacacaggaacagaaaaccaaataccacatgttctcattgataagtgggagctaaacattgagtacctatggacataaagaggcaacagtagacactggggactactgggaggggaaaggaaggggaaagggttgaaaaaaactgttgttatcctcactaccaggtgatgggaacttttgtgtcccaaacctcggcatcatccagtacaccatgaaacaaacctgtacattcactgcccttgaatctacaataaaatttgaaataattaaaaaaaaaaaaaagaggctgggcgtggtggctcacgcctgtaatcccagcactttgggaggccaaggcgggtggatcacctgaggtcagaagttggagaccagcctggccaacgtggtgaaaccccatctgtactaaaaatacaaaaattagtcaggcgtggcagtaggcacctgtaatcccagctactcgggaggctgagacaggagaatcgcctgaacccgggaggtggaggttgcagtgagctgagatcatgccattgtactccagcctgggcagcaagagcgaactccatctcaaaaaaaaacaaacaaacaaaaagaatatgttgcacacaacttacaaataataatgaactatataatactcttaattgaaagcttttgttgatttttgccaaatttttagctaaactgtggttgtaacttataacgaaagtttgacaaatggagctgcatcccagtttgctcttttctcaataactgtattgccgttaaatctgatatgtgatctactgttaaactacttctcgtccacatacgaactatattcattgaactgaatcctctttcagctttagcactaaatgaagccctgatttataatgtttgccagtttcaagggtgtaaatactcccatcatggccaatttcaagctaccagtgtgacatcactgaaacaaagaggggaggagaagcatagtagcatgttgtgatgtaatattcccaccatgcagacaagacatgcacaatcaatataaataacctcaacagcatagataatagtaagatatagttaaataataggaagttgagagatttgagtattctttaacctttgtttttaatgttaatttatttaattgctatttgatttctaataaacaactggctttcagaatttctgagaatttaacagtcagctttcatgggccagtgcaagcatgggataatcagcaaaacagctaccatatcaattgagctgacatgtcaccaagggagtgttaagtaatattaaattttatcatctgtgggaggtttttgaaccgtgttcagtcaaattcccagaaacagaactgtcacttttcattgtgtttagagatttttctccctttactagttgcagaacagtccttatacatctgagaggaaaaaggaagataatcactttactctgaggaaacacagggccagatgcagtggctgacacctgtaatcccagcactttgggagaccaaagcaggagaatcacttgaggccaggagttcaagaccaccctggacaacatggcaagacccacatctctggggaagaaaaaaaaaacttttttaattagccaggtgtggtggtgcatgcctgtagtcccagctaatccggaggctgaagtgcaaagattgcttgagcctgggaggtcaagactgcagtgagtcatgaacacattactgcactccagtctaggtgacagaacgagaccctgtctc

SEQ ID NO: 64980 - DNA, 5183 bp, Homo sapiens
gtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtactggctgcccagctctgctgcttttcttccctttttctttattttcgatgcatactctttcttatctccagtgttacttcatgagtctgggtagagtatatcaaaccatgatggagaggagatcagagagagtgctggttctgcatatgtgcagggccactgccatccatcctgcaggagcacacagttctaaaccctttgagaggtgcttgggaaactgcatttatccgtaaccacaaaaagtttctacataacaacccagaaatgatctattgagctcagaagaagcctctttttaacaaagagaggaaggagaagtgaggaagccaggagactgcagtggcaggtctggaccaaatgacacctgcaggctctaagcctttcatgtgtagagaagaaaacttagccatggagatgagaacaggaccagacaccttcatcctgtccttgaagaccaccactctagagataaggggagaagatgattctccctatttatactcagactgaccaagggcacctcgaagtgcttctgttagtactgatcagttctctgaaaatatttccaaaatatgtttgctttatgtataaaaactcgatttcacaatattggtgaaaagaaaaatgctggtctcacaaatgtgggcctctgggaaaaaaaagtctggcctcatagtattttgtttcagtcctgaaaacaaactgaggactttagtggtttcatagtgaaatacaagtcatagtatgacttcattctgcggtattcagtgctgttacgaggggagaaagtgggactcctccactcctttgggaactgagacgtaggcctctcaatgacatctcagagccttagaagtttactgtagcacagtgattgtgcacctgtgacatcccattcatttgaatggacacctctaggaacaatgataactgggcctcgttactattttcgttttctttttagagacaaagtcttgttctgttgcctaggccagagtgcagtggcatgattgtagctcactgcagtcttcagcctccccagtagccaggagtataggtatgtgccaccacactcagctttatttttttcctattttgtagaggcagggtcttgctatattgctcggaggtttgctaaaactcgttggatcaagagatcctcccactgtggcctcccaaagcgctaggattacaagcatgagccacggcagccagcccttcttactattgctgtcacttcatattctgatcttagctgggtctttcctgctgttcagcccttacactgccaagccatccttttcttcatctttcattgttttccccagagcagaaatgtaactcatatgtacttctttcaagatcctatcacgcctcttctgcccttcatcactgtgatcgagctcatctcaaggtgcctgtatctcaaaactcttatcagttcttacgtacgctcacctctactttgccttagagaaggaagtacttaccttcctttccagagcaattgtctcctcctctacactcttaacccacggtgttgctcattctctcacgttatttcattctttttctaaattcacactaccttttttctcagtttctacaaacctatgaatgtagaaacctacctaacctaaaaaagaaatgttcctctcccttgctaaccagaagcaacatcccatctcttccctttcacctctgccaaacctgtcctaagagtcctctatactggctacattcacctctttattactccttaaccacttgcattctggcttccatgaatgagagaggaggcaactcattaaaatgataagctttaggatcagacacaactgggttaaatcctgtgtccatacttaatttatacaagggcttgaacaagtcacttaacctctctcaatcgcacttttcatctataaaaagggtgttaaaagagtcagtgtaagcattgaaagagataaagcctttttttaaaagaggtgttaaagtctcttttaatcttatatagtgcctaataaatagtatctgtaaaaaagaaaataacccaacctccctacattctaccaagctgctcttttaaaagtcactaatgactgccattcaccaaataaagcagctttgtcttattcctcacatctctgagcccctccatagtattagcaataataaacctttttttttttttttttttaaacagagcctgggcaacaagagcgaaactccgtctc

SEQ ID NO: 64981 - DNA, 4613 bp, Homo sapiens
  misc_feature (3746)..(3746): n is a, c, g, or t
  misc_feature (3846)..(3846): n is a, c, g, or t
  misc_feature (3885)..(3885): n is a, c, g, or t
  misc_feature (3891)..(3891): n is a, c, g, or t
  misc_feature (4359)..(4359): n is a, c, g, or t
  misc_feature (4384)..(4384): n is a, c, g, or t
  misc_feature (4462)..(4462): n is a, c, g, or t
  misc_feature (4470)..(4470): n is a, c, g, or t
  misc_feature (4589)..(4589): n is a, c, g, or t
  misc_feature (4604)..(4604): n is a, c, g, or t
gtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccngaacacttctgttgttgtcactcttctgaagaaaggagccaagataggttgtcagacgttccgagtcgcccacgaggtccagccacatgggcgatggccncctccaagccagacatcatgatcatcctgttgagcaagntgatgnaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctgcccaggaggtggtggtgtgcatgcggagggacacagcgctggagacagccntcaatgctaaggcctacaagcgcanaacgcccacgtcccttgcgcgaggcccgcatcacttgagaagctggagaagcagcagaagatcgagcaggagcgcaangcaggcangaaagcaccaggaatacctcaatagcattctccagcatgccaaggatttcaaggaatatcacagatccgtcacaggcaaaatccagaagctgaccaaggcagtggccacgtaccatgcnaacacggagcggganagaaagaaa

SEQ ID NO: 64982 - DNA, 11867 bp, Homo sapiens
  misc_feature (3746)..(3746): n is a, c, g, or t
  misc_feature (3846)..(3846): n is a, c, g, or t
  misc_feature (3885)..(3885): n is a, c, g, or t
  misc_feature (3891)..(3891): n is a, c, g, or t
  misc_feature (6744)..(6744): n is a, c, g, or t
  misc_feature (6922)..(6922): n is a, c, g, or t
  misc_feature (7143)..(7143): n is a, c, g, or t
  misc_feature (7176)..(7176): n is a, c, g, or t
gtaatttgctctaacagagggtgaactaaactgcgccacagagaaaaattgtgtaaaaatatttcttttatcctaatggaatcatacaacctatatttgctgcagtattctgaaaggacaagcttatgtcaaccaatctaatgaaaagaactcgtctgtgtaatctcttgaaatcattagttgttcaaaacagaataccacagtgcttctctggatacaaaaagaagcaggtgatgttgttaggggttctaaacccctttgggagcatctcttgtgctttgggaccataatcaacatctgctataagaagtatcacctgtaacgcacagtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagccagtagcccctgctctacactcccacccatcagtacaaatgcaactgccaaggactgcagctatggggctgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcaatctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggcctccagatatctccttgaagcctctgctctttgaagtgcccagcatcactacagagtcagtgtttgttggccgagattgggttttccacgaaatagatgctcaacttcaaagttcaaatgccagcgtgaaccaaggagtagtgattgtgggaaacattggattcggcaaaactgccatcatctccagactggtggccctcagctgccatggtacaaggatgagacagatcgcctcagacagcccacatgcctcccccaaacatgtggatgccaacagagagctgccactcacacagccaccttcagcccactcatctatcaccagtggaagctgcccaggaactccggaaatgcgcaggcggcaggaggaggctatgcgaagactagcctcgcaggtggttgcctatcactattgtcaagcagataatgcctacacttgcttggtgccagaatttgtccacaatgttgctgccttgctctgccgctcacctcagctgacagcctatcgggagcagcttcttcgggaacctcacctgcagagcatgctgagccttcgttcctgtgttcaagaccccatggcctccttccggaggggagttctggagccactagaaaatctccataaagagagaaaaatcccagatgaagatttcatcattttaattgatggattaaatgaagcagaatttcacaaaccggattatggggatacaattgtatcgtttctgagtaaaatgatcggaaagtttccttcttggctcaaactaattgtaacagttaggaccagtttacaggaaattaccaagctgctgcctttccataggatttttttggatcgactagaagagaatgaagccatagaccaggacctgcaggcttacatcctgcaccggatacacagcagctcagagatccagaataacatttcacttaatggcaaaatggacaatactacatttggcaaactcagttctcatctcaagaccctcagtcaagggtcctatctatatctgaaacttacatttgacctcatagagaaaggctatctagtgttaaagagctctagctacaaagtagttcctgtttcgctctcagaggtttatttactccagtgcaatatgaagttcccaacccagtcttcctttgaccgggtgatgcctctcctgaatgtggcagtggcctctctccacccactgactgatgagcatatcttccaggccatcaatgctgggagcattgaaggcacactagaatgggaggattttcagcagagaatggagaacctctccatgttcctaatcaagcgcagagacatgactcgtatgtttgtacatccttcttttcgagaatggcttatctggagagaagaaggagagaaaaccaaatttctctgtgatccgaggagtggtcacacgttacttgccttctggttttcccgccaagagggaaaactaaaccgacagcagactattgaactgggacatcacatcctcaaagcacacatttttaagggtttgagtaaaaaagttggtgtatcatcctccatcctccaaggtctctggatctcttatagcacagaaggtctttccatggcactggcgtctttacgaaatctctacactccaaatataaaggtcagccgactgctgattttgggaggtgccaatattaattaccggacagaggttttaaataatgctccaattctatgtgttcagtcccatcttggttacacagaaatggtagccctgctgctggagttcggggccaacgtggatgcctcttctgaaagtggcctgactcccctgggatatgctgcagcagcagggtacctgagcattgtggtgctgctgtgcaagaaacgggccaaggtggatcatttggataagaacgggcagtgtgctttggttcatgctgcactccgaggtcatctggaggttgtcaagtttttgattcagtgtgactggacgatggccggccagcagcaaggagtatttaagaagagccatgccatccaacaggccctcattgctgcagccagcatgggttatactgagattgtctcctacctacttgatcttccagaaaaagatgaagaggaagtagagcgagcacagatcaacagctttgacagtctctggggagagacagccctaacagctgcagccggaaggggcaaactggaggtgtgccgtttgctcttggaacaaggggcggcagtggcccagccaaaccgccgaggagcagtgccactattcagcacagtgcgccagggccactggcagattgttgatcttttactcacccatggagctgatgtcaacatggcagacaagcagggccgcactcccctgatgatggctgcttccgaaggccatctaggaaccgtggactttctgcttgcacaaggtgcctccattgctcttatggacaaagaaggattgacagccctcagctgggcttgtttgaagggccatctctcagtagtacgttctctggtggataacggagctgccacagaccatgctgacaagaatggccgtaccccactggatctggcagctttctatggcgatgctgaggtggtccagttcctggtagatcatggggccatgatcgagcacgttgactacagtggaatgcgccctttggatagggcagtggggtgccngaacacttctgttgttgtcactcttctgaagaaaggagccaagataggttgtcagacgttccgagtcgcccacgaggtccagccacatgggcgatggccncctccaagccagacatcatgatcatcctgttgagcaagntgatgnaagagggggacatgttttataagaaaggtaaagtaaaggaagctgcccagcgctaccagtacgccctgaagaagttccctagagaagggtttggtgaggacttgaaaactttccgggaactaaaggtgtctctcctcctcaacctctctcggtgtcgcaggaaaatgaacgattttggaatggcggaggaatttgctactaaggccctggagctgaaaccgaaatcttatgaagcttactatgcgagagcaagggcaaaacgcagcagcagacagttcgcagcagccttagaggacctgaacgaggccatcaagctgtgtcccaacaaccgtgagatccagagacttctgctgagagtggaagaagagtgtagacagatgcagcagccacagcagccaccgccgccaccgcagcctcagcagcagttgccggaagaagcagaacctgagccacagcatgaagacatatactctgtacaggatatattcgaggaggagtacctggaacaggatgttgaaaatgtttccattggcctccagacagaggcccggcccagccaggggctcccggtcatccagagcccaccctcctctcccccgcatcgggactcagcctacatctccagctcacctcttggctctcatcaggtttttgacttccggtccagtagttctgtaggctctcccactagacagacctatcagtccacctcacctgccctttctccaactcatcagaactcacattacaggcctagcccaccacacacttccccggctcatcagggaggatcttaccgtttcagcccccctcctgtgggaggacagggcaaagaatacccaagccctcccccttcccctctccggagaggccctcagtatcgggccagccctccagctgaaagtatgagtgtctatagatcccagtctggttcacccgtgcgctatcagcaggaaacaagcgtcagtcagcttcctggcagacccaaatctccattatccaaaatggcccagcggccctaccagatgcctcagctccctgtggcagttccccagcaagggctcaggctacagcctgccaaggcccagattgtgagaagtaaccagcccagcccagccgtccattcaagcaccgtcatccccacaggagcctatggccaagtagcccattcaatggccagtaaataccagtcttcacaaggagacataggagtcagccagagccggttggtttatcaagggtcaattgggggaatcgtaggggatggaaggccggtgcagcatgtccaagccagcctgagtgcaggcgccatctgtcagcatggaggattgaccaaagaggatcttccacagcgaccttcctcagcataccgaggtggcgtgagatacagccagacaccacagatcggacgcagccagtcagcatcctattacccagtctgtcactcaaaactagatctggagcgctcctccagccaactaggttcccctgatgtgtcgcatttaatcagaagacctatcagtgtcaaccctaacgaaatcaaaccgcacccgccaactcccaggccgttgctgcattcccaaagtgtaggccttcgcttctctccatctagcaatagtatctcctccacctccaacctaactccgaccttccggccatcttcttccatccagcaaatggagatcccactgaaacctgcatatgagaggtcatgtgacgagctgtcgccagtgtctccaactcaaggaggttaccccagtgagcccacccgatccaggaccacaccattcatggggatcatagataaaacagcacggactcagcagtacccccacctccaccagcagaatcggacctgggcagtgtcatctgtggacaccgtcctcagtcccacgtctccaggcaacctgcctcagcctgagtccttcagtccaccatcatccatcagcaacattgccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatatanttatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctnctgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgntctagtggccctcttcctgtaaacccagatggngtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccaaagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtgctcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatttcagagctgccccttccccagcagcaaacactcgctgagtccatgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacatcatgtctataaatgggtgcactttactgtttgaatttgtaactgaagtactggatatttaagtgtgagtaatgtcttcattagaaaatagcagaaccgctcttgtcttttagtgtatttttcaagaaaaaaggaaaggaaagacatcaagcagtggatcacaacatttatagcacaagaaataacttgtatataagcatcaaaaagattaagaattttttaatatgaaaaatatttgcagtgattttaaagtgcttttccagcaatgttcttagggactcctgagacacggttactttatctactggatcagtaaggcacacaattaacaattaacaattaatgtttatttacaaagtaaagggaaaacctgtgtaacatgagaatttggcatgacaaaatggagaccattttgtatctgctgttgtatcttgtccgggttgcagacgtgcactattaaagtcccaagttaatagagcacaaacccttctcgctcctcccccatgtgcccctctttttagatgtgtataacttaaactcgatggctcaggaaaattccactaattagaatcatgtacagtaccccaggtcgttgtccagatatacaagtttgctaatgtagttaagcctggattattaaacacttttcctaaattattgtaaacagaacagcttagagaaaggtattctcagtccttaatattgtatagtagtttatgagcccctctctaaatattggtatttttatattccagagatgtacccaatagaaaaaattaaaaattaatcagtatctaatttaatatccataagtatttttccttagattttagtcacgtacagtgggctatgtggatgtcacttgtgcttcaccatagtttaccactaggtgtcactgtggctctgcactgcgcttgttttgtagcaaagaacagcggcatcccctcgggagagaggagctgcttccaggcaacaggcaagcgggctcagaggttcaggagaaggcaacagaggcctggaaggggtcttcgtgcatctgtgccagttgtgcaagacgaactctttgaacactacatgctttggacttcagccaggcagaggctggaagaaggttgaccagagctcccttgctctggtagagggatgggtacatggagaagccccttcttccccatgagcctccctcctgtcagttcctctcagcctccagcttttataactccagaagcgtcacagttgggtggtttgattcagagagagttatttttctactgcagaaatgccttggacaaaaccagtgctcactgaatctttgccacaaaatggaataggctatcccagggggcaagaggtgcccgcccctgtgcccagcctcctcttgatgctcccagtgcccagcagcctcgcacaccctgcctgtctgttcctgggctgcccatttctcaagaaaccgacctgcaaaggcagccggctgctgcctccacaccgagggctgtgcggtcctgctgctcgctcactgggaggtgcagctctttctcctcttcctctaggaattccagaccgaccatctaccatgactaacaacaatgaacaaagggcttaggggcaagagctacctgcaaagacgtgtcatggaacccttcaccatgcaatgccttgaactcagctctggctgctcccaagaaaaggtggctggctgggggcctggacacaagcacaatggggctggtggagccactgtgcagagctacttgaataatcactgggttttcatcaactccttttgtcatacagaccactcaagggctgaagtgttggtaaccttcatttcggtgtccaaagcctcacagcaggtgagccaccctgagatgcttgtggccacatggtggccacagtcagagctttgaaagtcagtaccaaatgaacgcataattggacaccaaaaatcaagtgttactttcatgtttcctcaccccatcatctcattgcctcctgctgactctgataccgacgctgagctgacttgccaggctgccgctggacgcgtagagatcaggccagcgccgcgctcatttttccaggtagacctactctgtggaacggaagtgccctagctgctttgtttttgtagcacttgctggctgaatttttcttttgctaatcgctaaccagaaagtctggttagagggggctcaactcaatccctttggtccccagcgccagacaagagttaattctggaaaattcagtacttgaatgtacctgccttattgcataccaatttactggggggaaaaaaaaagttaagagatgccggctccagatctccacttcattcacaggtgattttggaaatcctgtaagttacacttcctgttctggttttgttttgttttttgtttcctttggctgattcctgctgagtgaggccagttcctcatcaggctcagggcaggtgccttttcaggcgtggcctcctttccatctagcacagcatctttgtctctgttctgtctcctccaaatccaagatgattttaattagtacagacatgtacagtctacaattaaagagtgatttgtactaatatgattttgattcttcctcctctttgctgtcctttcaagacacttgctggaaaaagctttaatgcacttagttttcctttaggttttctatgactcagatgtaaaggactttctctgtacagtatattatccaatgcatgtttgttctctctcctgatatattgaacaccacacagttgtgaagccgtgcagtggggatgccccacaccccacagaggcatctacccctgtgtataaggaaagacattttcctttgctgtacttgcttgagcagttttattgtctgtacatgtgagctgtgtgagatagatgtgaaaagttcaaatgaatgcattttcctgccccatgtatacagattgtcatctgtacaaggaactgtatgtatgaaagcaaatgtacttatttataaatggctaacacttggaaaaa

SEQ ID NO: 64983 - DNA, 576 bp, Homo sapiens
gagacagagtctgcctctgtcacccaggctggagtgcagtggcgctatctcggctcactgcaacctttgcctcctgggttcaagtgattctcctgcctcagcctcccaagtggctgggattacaggcgcccgccaccacgcctggctaatttttgttatttctagtagagatgaggtttcccccatgttggtcaggctggtctcaaactcctgacctcgtgatccatccacctcggcctcccagggtgttgggattacagacatgagccaccgtgcccggcgccttatacgatttctgcagacaacataggcagaggctgagagagtcagagaacacgtttgagcctgggtccctgtcttagtgaataggagatctcgagcagcaagttcctccacctctctgggtcttttatcttcttcatctgtaaaatggatatataagagtggtacttacctcatagactattgtaagaattaaacagggtactctatgtacagacttagcacagtgcttccatgtaatagtgttggacaaatattagctattaaaatatcctcaccatttaaactttaaaa

SEQ ID NO: 64984 - DNA, 436 bp, Homo sapiens
ctgaaatttttttttttaacaacaaaaaaaacaataaagagcaaacagaccagcagaataaatgtaggacaaacctggccttgagtcatggctctaccactaataaacatagtagtcttaatctcgtagaatctcaggaccttgttgtcatagggctgttggaggaccaaatgagagcgtttattaagcctttctttatcaaagtcttgcccattgcttttaaaacggcagcaattattatggagaataataattattttcagaaaggatattctccattttatccattcctgtgcctttgtaaagctctttacagaatttgaaagtaaagctcttaaccatttatattgcagatattatccctagtttgtcattttcttttggaagtttctggttttcacttgggcaaaatatactgtcttaatgctttctggat

SEQ ID NO: 64985 - DNA, 243 bp, Homo sapiens
gagactccatctcaaaaaaaaacaaacaaaaaaaacactcctggcctcaagcaatccttccaccttggcctcccaaggtatgagccaccacatccagcctccttaagcaaagtctttcacataatatattgcttttaatattaaacattttttactttatgtttcttatttttaaaaaatacagtgactaacacttgttttaagaaaaaggccaggagtggtggctcacgcctgtaatcccag

SEQ ID NO: 64986 - DNA, 964 bp, Homo sapiens
gcggaggcgagagaacctcttagctaggttccgccgaagccccacccactgcgcagaccccgcctcccaccgcagggcacgcctcctacccccacccttcgcggattgatcctgctggccgcagccacccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagggctttgtttggtggtaaaaagggttactagacacccctcattccactgccactggagggcgcatttctcagctcttgctcttcaaacctgctgaaaggaattcctagatctaaacaccagcatcccctgcacaggagtgatggacagttgggtgcaaaggtgatgaaggtgggatccccgaggcattgtcactacagaacaaccatgaaatagactccttatttcagaggaagagttacatattaatccacttctactgattttgtagagggagaaaagtcagggactgtgttgtattcctgtttgcatcctttaatcatctagtataattcctttaatatggtagatgctcaggaactacctgagttaataaaggaagagaaaacttgaacaaattgtgacggcctgacttgcactgttaatacttctggctttcataaatctaagcattcaggataagagtcctatgaatcattaaaatacatataatcaaaattaagagtgatctttttctaaaccaaacctgacaatagatcaacgaacaaaattcattggtttgaaattcattttttcaaattgcttttttcagtggcccacttaactttctagtggaaaactcgcaaaaacaacgaaatataattgcataagattgttttttagttgggg

SEQ ID NO: 64987 - DNA, 920 bp, Homo sapiens
gcggaggcgagagaacctcttagctaggttccgccgaagccccacccactgcgcagaccccgcctcccaccgcagggcacgcctcctacccccacccttcgcggattgatcctgctggccgcagccacccacgtggtggaagcccggccctgcaggctggagaggatttgattagactacgcgtttcgacttgcagggtgtttaatcgtcgccaagcgggacttactgcaagctatcaaatctgaggtcttattttgttgagtcgaaagtgaaattttcctttggccaacgtgacagggctttgtttggtggtaaaaagggttactagacacccctcattccactgccactggagggcgcatttctcagctcttgctcttcaaacctgctgaaaggaattcctagatctaaacaccaggtacacctctattttcaagtgtcgtcaggaggaaacccatcaaaccctacatttagcttactagagaaatacattgttctgctgtgtcagtttggcgagtaacataatgtttcgttattaactctcaacccctgtgttttcagtttttttttttttaacatgaaaaattgtcattttctctaattggtatgcctgttcctttggcagtgaggttgtcagtacacatgcttctggaatagtcttgtaaatttcttgaggctaaaaagcacaggtctagttagctaactgactcatgcacctctccccttggattccccacaggtctcagattcagcatttaaaattgaactcgtcatctttccctgcctcccttaaagaaaaaaagtcaatatgctgcttctactgtgtgcgtgccgtgctcagtagtaccactgtccaaataattgcctaagctagacagaggaagctgggaagaatcttagactctggctttccacccaca

SEQ ID NO: 64988 - DNA, 704 bp, Homo sapiens
ccagccttgtcaaatgtcctgttttgttttaaactttggtgggtacagtaggttactgtacttcagtgagtaaagtaggttactatactttcgtgagtgtagtagtaacagcttactatgaattttccctgcatttgacctgttttcttccccagcagcatcccctgcacaggagtgatggacagttgggtgcaaaggtgatgaaggtgggatccccgaggcattgtcactacagaacaaccatgaaatagactccttatttcagaggaagagttacatattaatccacttctactgattttgtagagggagaaaagtcagggactgtgttgtattcctgtttgcatcctttaatcatctagtataattcctttaatatggtagatgctcaggaactacctgagttaataaaggaagagaaaacttgaacaaattgtgacggcctgacttgcactgttaatacttctggctttcataaatctaagcattcaggataagagtcctatgaatcattaaaatacatataatcaaaattaagagtgatctttttctaaaccaaacctgacaatagatcaacgaacaaaattcattggtttgaaattcattttttcaaattgcttttttcagtggcccacttaactttctagtggaaaactcgcaaaaacaacgaaatataattgcataagattgttttttagttgggg

SEQ ID NO: 64989 - DNA, 1834 bp, Homo sapiens
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 64990 - DNA, 1798 bp, Homo sapiens
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactcccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 64991 - DNA, 1885 bp, Homo sapiens
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 64992 - DNA, 443 bp, Homo sapiens
aaaccttaacatttatggtcaattgatttttcacaagggtacataaacaattaattgggaaaagaacagacttttcaacaaatagtgctgggacaactggatatccagatgcagaagaataaagctatacccccacctcacacaatatacatagattaactcaaaatggttcaaatacccaaaactaaaactcttcaaagaaaaaaaaggggaaaatctttgtgaacttatctggcaatgttttcttaggtatgacaccaaaaacacaagcaaccaaaataaaaataaataaattagactatcaaaatttaaaattttaggccaggtgtggtggctcacacctgtaatcccaacattttaggaggcaaagacaggaggactgcttgagcccagaagttcgagatgagcctaagcaacatagacctatctctacaaaaaaaaaa

SEQ ID NO: 64993 - DNA, 420 bp, Homo sapiens
cagattccacctgaaatcacctggaggatgcctggagtgctgttccacaccctgggctccccctgaagttctgactccttatccctacctctgcagacacactggctgggccatctggggccaaggttggtgaaaacccaggcgtctgggtccccagcagcaagaacaactcccaaggagacagaggccggccccctgcataacaactttgatggctgcggcccaccctccaaccacctgacacatgtcatgccaacggctctgagcctcacatcttcaaaaactggatgccaaggagacccaccaaaaacatgcgggtaacatttgttatggctttgaagataaaagtcaattgaagtaagccctcgctgtatttcaagttttccctctagcatggagcaagctgcctggcagtttaga

SEQ ID NO: 64994 - DNA, 787 bp, Homo sapiens
gtcttatgtaattccaaactcccctgtgaggtgggtgctctcttctccatcataccgatagggaacggaggcccagggcagttccataacaaggccatgtggccagggtcactttgtggtctccatccagatagcatcctgcctgccaagtcagtgggcgtgtcccctttgctcctgcctgccctcttcactggagggcctcactgcccaggtgtactctgagcatggggctactgctggcaggtggcagggagtctccccagtctcttgatgccattccaataccttgtctgctctttagcctaacgcacctctcggggtggtcaggagagcgggtggtagaagcctgaaagatcagctccctggggacacagccagagcttcgtcctcagtgaccacagggctgagccaggctcaaccggcttctggctcttgttttgcagaagaagaactagaagcaaggtgctttcctccgggtcccagagctgttagtgatggagccaggcctgggatccagctttcctgagttcctgacccctgctcatttcatagtcagctctcagcacttaccagaggaacaggcagccttttggctactgcccttcagagaaagagagatgagagaattcaaatgcgtgttggtgttccctgttagtacaagcagcagcagggggaagaactggaactagtgagtggagtgaaatctagggattgcccctcagtttcagttgtccttgttattcctccctgttaagctccccctgcagattcatttcttcactcattc

SEQ ID NO: 64995 - DNA, 1001 bp, Homo sapiens
  misc_feature (553)..(553): n is a, c, g, or t
  misc_feature (750)..(751): n is a, c, g, or t
cccgtctctactaaaaatacaagaaatagccaggcgtggtagctggtacctgtagtcccagctacttgggaggctgaggcaggagaattgcttgaacccaggaggcagaggttgcagtgagccgagattatgccactgcactccagcctgggtgacagactgagactctgtctcaaaaaaaaaaaaaaaaaagaggaagaatttagtaacctttaaaatgtgttaccatttcatatggtcaggtagacaataaacacaaattcagacttgcatttcaactaaaagtctcctctttgtctattttatttgtgctgaaatcacagtcatattcacttgcgtttctcatgtcggtcagaagtgttggtactgttttatctgatttaatgtaatagaaaaatgccaggtacgatggctcacgcctgtaatcctagcactttgggaagccgaggggggtggatcacgaggtcaggagttcgagattagcctagccagcatggtgaaattcagtctactaaaaatacaaaaaaaaaaaaaattagctgggcatggtggnatgtgcctgttagtcccagctactcgagcggctgaggcaggagaatcacttgaacctgggaggtggacgttgcagtgagccgagatcacaccactgcactccagcctgggcaacagagcaaaaccctgtctcaaaaaaaaaaagaaaaaaaaaagtaatagaaaaatattaggccaggcgtgtggctcacgcctgtnntcccagcactttggaaggccaagatgggcggatcacaggtcaggagttcgagaccagcatgaccaacatggtgaaaccccatctctactaaaatacaaaaattagccgggtatggtgtcgcgcacgtgtaatcccagctacttgggaggctgaggcgggagaatcgcttgaacccgggaggtggaggttgcagtgagccaagattatgctactgcactgcagcctgggcgacagagtgagactctgtctc

SEQ ID NO: 64996 - DNA, 668 bp, Homo sapiens
cccactgcacttgccagggctgccggggcccagccttgcccctagcttcctctggcgggagctatggctcggaggagaatggggacctctgaacatacctgcccgcaagggggaccggaggtgctcggagtgggcttgtgagggaggtggtgccgcagtccccgctgagcagcctggccccccagatcgtgtacttcactgctacattcccctacgtggtcctggtcgtgctgcttgtgcttggagtgctgctgcctggcgccctggacagcatcatttactatctcaagcctgactggtcaaagctggggtcccctcagccctgggcagctacaaccgcttcaacaacaactgctacaatgggaccagcttctttgctggcttcgtggtcttctccatcctgggcttcatggctgcagagcagggcatgcacatctccaaggtggcagagtcagggagatctctgtggccctctgttgtgccctccgctttgtcattgatctctccatggtgactgatggtgggatgtatgtcttccagctgtttgactactactcagccagcggcaccaccctgctctggcaggccttttgggagtgcgtggtggtggcctgggtgtatggagctgaccgcttcacggacgacattgcctgtatgatcgggtaccg

SEQ ID NO: 64997 - DNA, 433 bp, Homo sapiens
cccactgcacttgccagggctgccggggcccagccttgcccctagcttcctctggcgggagctatggctcggaggagaatggggacctctgaacatacctgcccgcaagggggaccggaggtgctcggagtgggcttgtgagggaggtggtgccgcagtccccgctgagcagcctggccccccagatcgtgtacttcactgctacattcccctacgtggtcctggtcgtgctgcttgtgcttggagtgctgctgcctggcgccctggacagcatcatttactatctcaagcctgactggtcaaagctggggtcccctcaggtgaggtggaggtggggaggctgcagcagggtgttgtgggggagccctgcaggcccctcatgcctgcactctccagccctcctctaggtatggatagatgtggggacccagat

SEQ ID NO: 64998 - DNA, 329 bp, Homo sapiens
aagcaaactcataagcaacctttactctgaagtgtccccaaagtacttggtagtgtagcagggtccttcacacaggacaggatgaatttcagttactattgactgaatgataattatctgattcttgtcttctcaactagattgttttaaacatcaacattcagagttgtcaattaacactcctaaactgctttattaggcatataagttaagacaaatgaacaattaatttaagatttttgtgtaaagtgctaaaccaaaataaccaggaaaggagattaaaaacacttctaaagctttaaaaatcagaagattaagattatttgtac

SEQ ID NO: 64999 - DNA, 703 bp, Homo sapiens
gtagtcccagctactcaggaggctgaggtgaaaagattgcttgagcccaggagactgaggctgcagtgagccatgattgcacctctgcattccagcctgggcaacagagcaagaccctatctcaaaaagaaaagaaattgagactcaggtctcatagctggtgaacagcagagccagtatttgagcccaggactgcctgactccaaaacctgagctcttccctcactgtgctgcctctcctggtgtgggcaaacaggattttaatgggagtaaggtctgccatgggttaggacatcacctttggcccagtttcaaaggaaggtgcagacttgaaggacagaagctcattagctgagtctctggggaccacgtttgcaatggtcccacctgcaaaccagatgagggaataaaattcagtctaccggccaggtgcggtggctcacgcctgtaatcccagcactttgggaggctgaggcagacagatcacaagatcaagagatcaagaccatcctggccaacatggtgaaaccccgtctctaataaatatacaaagattagctgggcgtggtggtgcacgcctgtagtcccagctgcttgggaggctgaggcaggagaatcgcttgaacccaggaggcagaggttgcagtgagccaagactgtgccattgcactccagcctggccacagagtgagactccatctca

SEQ ID NO: 65000 - DNA, 1140 bp, Homo sapiens
aatcatcttgttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaaaagt

SEQ ID NO: 65001 - DNA, 920 bp, Homo sapiens
  misc_feature (815)..(815): n is a, c, g, or t
  misc_feature (877)..(877): n is a, c, g, or t
  misc_feature (897)..(897): n is a, c, g, or t
  misc_feature (910)..(910): n is a, c, g, or t
  misc_feature (920)..(920): n is a, c, g, or t
aatcatcttgttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggaacngcattgaaattccccgaaaaaagaactcttcccgttgaaattccttggaaaaaaaatttcanaaactccccttgcttgaaanccgcctccccaangaaaattcan

SEQ ID NO: 65002 - DNA, 1008 bp, Homo sapiens
aatcatcttgttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaaaagt

SEQ ID NO: 65003 - DNA, 546 bp, Homo sapiens
aaggttaggcatacagttatggtatgatccagcaattccacttctagttatatacctaaggtcacacaaaaacttgtacaccagtattcagagcagcactattcacaatagcccaaaggtagaaatacccaaatgtgcatcaaatgataaatggataaatagaatgtagtatatcctacaatgagaattattcagccaaaaaaaggcgtgaaatatcaatacctgctataacatggatgaaccttgaaaacattatgttaagtgaaagaaagaagcaaaggaccatatattggatgattccatgcatatgaaacattcagaatagggcaatccgtagagaggaaatagattagtggttgccagaggctgagcaaaaaggggaattgggaagtacggggtttctctttggggtggtaaaaatattctcatattagatagtggtagtagctacacaccattgaggattacacattgaattgtacactttgcaatgtttaaaataattaattttgtgttatatgaattttacctcaataaaaattttca

SEQ ID NO: 65004 - DNA, 254 bp, Homo sapiens
aaggcactcacactacctgtgaaacagtatagttatttgtatgtaggtctggatttgttataaatgtatattgcaaactctagggcaaccaggaaggagataaattataatcatataaaatgttctattaaactcaccaagagggctgggcacaatggctcatgcctgtaatcccagcactttgggaggccgaggcaggcagatcacttgaggccaggagtttgagaccagcatggccaacatggtgaaaccct

SEQ ID NO: 65005 - DNA, 485 bp, Homo sapiens
cctcctgagtagctgggattacaggtgcgctgtaatttttgtatttttagtagagacgggtttcaccatcttggccaggctggtcttgaactcctgacctcatgatccacccgcctgggcctcccaaagtgctgggattccaggcgtgagccaccgcgtccggccgcctggctaatttttgtattttcaatagagacggggtttcgccatgttgtccagactggtctcgagctcctgacctcaagtgatcctcctgcctcaccctcccaaagtgttgggattacaggcataagtcaccgcccctggctgatactacttattttaaaatgatgaacaaagtgaagggcagtttctgtagctctctacttgagtcacttggagcagggattctgaacgctagagacctgaatacccagtttgtgaataagtttcctgtctctctcttagctgcttcacttcatattcttagtatctttgttaaaggg

SEQ ID NO: 65006 - DNA, 319 bp, Homo sapiens
gatgctggtgttacgcttcctgcacagcctgcagaactgtgagctagttaaacctcttttcttataaattatccagtctcaggtatttctttatagcaatacaagaatggcctaccacgagtgatacctgtatttaatatacagccttcacaaaatatagtacagacttcctaaaaaaaatggatactctgtaaatttccttgttcatactacttctccagaatctgctaagagatggtatagaaatgataataaaatgatagtttacatttattaaaatatgggtaccaaaataagcacattcacaagattaatcaag

SEQ ID NO: 65007 - DNA, 365 bp, Homo sapiens
aaccttaagtttcttacttaggaaaacctgaaattcgcagtctataaaaatgattaactgggaaataactttcaatgataactctcagttttcaaaagtaatagagccccaaggccaaaaataaatgggccccaaaaatggcagattctcagatttcaaaaaaatagcatacacgcagacacacacatgaaaaaatgtggaaaagaaaaataagcagttatgaaaaaagctatggaatctcttaattacttgccatctgaaggtcccatgccagtgacaaatgccacagaaaagtttcattttacctttagccttcacactaatcagaccctgattaagtcgagacagccagcccagagcacctt

SEQ ID NO: 65008 - DNA, 303 bp, Homo sapiens
taaccagccagactggaggtatttcacttaaatcccaagtattcagttgagactccagaaagccataggaaaaatggctactctagccttaagagtgtcctaacaaaaacttaaagtaagccttaatatgatcagactgatccaccagaaaataacttctttccagaacaaaattcaatgcactttaaaagaaaataacaaatccagattatcaataaatacagtacataatacccagtaaatcatcaagttatgaggtatgttaagagacaggaaagtgtgacacataatctgggaggaaaa

SEQ ID NO: 65009 - DNA, 467 bp, Homo sapiens
acgtcctcctcacgccgatcctttccctctttcttccccttggacctctgtcctcaactttcttctgtccctttcctcgaaggacacctctcccaggactggggccgcgctccagggctccccctcccccgccacccgcgcagcccggcatatgcctcgacccagcacccgggcctcagaggagctggggtgaggcctgggacgtgacagactaggtccctgccctctggggcttccattccgtgggggagcagcagaaactggcgcgtctacctttgccagtagctaggagtgccatgagaacaagggaaggggtgggagggcgtcgcctacggagacgaaggaaggcctcccgcgctcatccgcctccgccttcggagcactgtgcttggtgtcataactttttactgaaaaaaaaatttcaaagagaaaatattctaaaataaacagcaataaatcagatgaag

SEQ ID NO: 65010 - DNA, 316 bp, Homo sapiens
atcagtaacatcaaacttgataatgtcaacaatcccttcttggcctgtgtggatatagcagatgaggcctctgttaatctcatcctgggtaaagttcattcccagagtaagattgttcctcacttctcctctgggttttctcagcctctgtagaagcccttgttgaggcccagaatggaggacaaaactgaggcttttatcatctgagtcaagatctgtggccttgaggatccgatttgtgatgatctcagagtgtcctttctctaccttcagcccattgttgacagtcaggtgaggagtttcatcatccactagg

SEQ ID NO: 65011 - DNA, 859 bp, Homo sapiens
  misc_feature (1)..(3): n is a, c, g, or t
  misc_feature (70)..(70): n is a, c, g, or t
  misc_feature (100)..(100): n is a, c, g, or t
  misc_feature (191)..(191): n is a, c, g, or t
  misc_feature (242)..(242): n is a, c, g, or t
  misc_feature (265)..(265): n is a, c, g, or t
  misc_feature (336)..(336): n is a, c, g, or t
  misc_feature (381)..(381): n is a, c, g, or t
  misc_feature (562)..(562): n is a, c, g, or t
  misc_feature (808)..(808): n is a, c, g, or t
nnngttatcaggtatactagttaacatgtttgacagcattctcaaaccttatatagcctggctgggcacngcggctcatgcccataatcccagcacttcnggaggtggatgtgggaggatcacttgaggccaggagttcaaaaccatcctggtcaacatagtgaaaccctgtctctacaaaagtagaaaantttttttgaaaattagctgagcatggtggcatgcacctgtagttccagctnctcaggagactgaggcagaggantgcttgagcccaggagttcaaggctgcagtgaggcatgattgcgccactgcattccagcctaagcaacagnacaagactgtctcaataaacaaaaaaacaccttatatatccttantagttttttgtccagttctgtcgataactgagaaggggatattgaaacctataacaacaacgatgtattgttcgctttgctgattagttctgtcagctgttacttcttgtattttgaagttatgttagtaagtgtatacatatttaggatcattatgtcttcattatctgttgactttttntatgtaaagaactgtccctcgtgggctgtgtgtggttgcacaggcctgtattcccagcgcttttgggaggccaaggcaaggcaggctgatttcttgagcccagcaattgagacctgcttgggcaacatgacgaaaccctgtctctacaaaaaaacacagaaattaacccagcgtggtagtcccaactacttgggaggttgagctgggtggattgcttggcccagggggtcgaggcagcagtgagcngagatcacaccactgcactccagcctgagcaatagagcaagaccctgtctc

SEQ ID NO: 65012 - DNA, 123 bp, Homo sapiens
tttactctaataaaccaatattttagattaagggaaaagagaaatggggtaagaccagcttatcttagtgaccaaagaactgaaaaaatgagaacactggaaagccaagtctcactgagtctg

SEQ ID NO: 65013 - DNA, 434 bp, Homo sapiens
tcagagcaacaaatttgtattttctaaagacatgaataatttcaaataaaagcaatgatgaaatatacatgaacattaccatgcatggttttttagttggaaaaatgtccttatagttacaagagctatttcacagtgttgtattgctgagagctatttgattaggttataatacaagagaaaaaacatttacagaaagctcaaatccagtaacctcatcaggatcaggaaacagcattgtactaaccaacgaggaaatgagagagctggaccctggacacaaaatgaggaatcggtatccctgcatcaaaatcactgcctgaaccatgcaccaaagctcaagcctggctgaaggatattgtgcttcccaggaggatacctggcccctgcttcataggggacatctctgaggtccttatagactcatccatgtc

SEQ ID NO: 65014 - DNA, 622 bp, Homo sapiens
cgcagcgtagctgtaagcacaagaagagattcagaaaagtccaacagggttgggttatgaattttacttctggttattcttagctctatatatataatacagggacatttcttaactagtctcagccttcatgtctagatttgtaaaatgggcttagtcaaggatttcaaagagtaattcaatcattatggaaaatacttagagtccatgacacaaagtattctgggagtttggaggagcatatgaaagaaagttgttatgaatactattcagtgctcagtttagatttcctgttactggcagggaggatttagagtaaaattttcagctctatattgtatttgttttgacttaggtaaattaacaattttaaagtcagttaattataggtgtgtaaattaaaagttaaggagcagcttgaatgtatctctttggggagtgtctgggcagcctgagcctccgtggctgctaattgaagaggaagaaaggggtcctgatgaaaaagttaggagttcctgaattttagtccatgctctgctaccatacattgtgaatatgaacaggaattttttttttttttttttttcaagactccatctcaacaacaacaacaaaaaaaaaa

SEQ ID NO: 65015 - DNA, 630 bp, Homo sapiens
aaaaatcttaaggcccacctcccttttcttgcaatttttaaatacaggatataaattcaaacattaagagttaatacgtggaaaatactataggtgttttagaaaacaaagataagacaattcctaacctagagcaatttaaaatttatgagccattagggaaatgcaaataaatgagatattactatgtgctcactaggatagctgaaatcaaaaggcagacaaataacaagtgttggcaagatgtggaaaaattggagccttcatacacctttggaaggagtgtaaatactgcagctgcttagaaaagcagtatggaagttccttaaaaagttagttacatatagtcgggcgcattagctcacacctgtaatcccagcactttggaaggccgagttaggtggatcacctggggtcgggagtttgagaccagcctgaccaacatggagaaaccccatctctactaaaaatacaaaataattagccaggcatggtggcacatgcctgtaatcccggctacttgcgaggctgaggcaggagaattgcctaaacccaagaggcagaagttgcggtgagccaagaccatgccattgcactccagcctgggcaacaagagcaaaagtccatatc

SEQ ID NO: 65016 - DNA, 861 bp, Homo sapiens
gggtggcaacattttactaggaaatcccatactcttgatgcataacggccttttctgggcagcattttgaaaatcacagtttgtattaggaagcactgtatttagagaatcttcatggactgtgataaagaaaaaaaacaaaagaaaaccccaaaaaacaaaaaaaaatactaaatatataacatgtatttaatagtaagtttttttgtggcccccacagatacacagagtttggcaaacagaacaaagcatatgtaccaacaatgcatgtttatattctgtgccatgccaggggcaaattcatagttggcctgtttccataagtgtggggatggaaccttgaaacacaggacatctcataatgctgtaagcagggaccattgaaattgattcctagagtcttgttctacaacttctttaaaaattactgatttgacagcagtatgtattcaacatttaagactttctgtctaattttgagcatacattcttgactaaggctagcaattagagattctttctttaatttatcagatatctattaattgtctacttttgagtgggctctgtgcaaggcgctaaaaagccagttactggggttctgttccttaaggatcctgagaattgagttgctaagaattaaatcagcaggcgtgcaatatgactgtcaaagcttgacccctgctttgattccctttgttgagacaggttcttataggacctggattctcaccacatcctctgttctgtttagggaacacaaaggtaagctcagctctgtgtccaggagtaccttatagtcctctcccttaactgtgtctgtttcaacttgatccaagatcaggattagtacaagcttgt

SEQ ID NO: 65017 - DNA, 409 bp, Homo sapiens
tttaaatgagcacctggagtctagaattaactaaaaaatatctatgttgatgcatattaagttgattttgaagtcataaattttgacaagaattgatactatggcactgtcataactttacaaaagatgacctgaactaacatgattttatgcttttaccagtggaactccctgaaatatattcagataatttgttattaaagcaaaactaagtttattgaaaccctgtgccaagaaagtacaccattttgacatacttttgcagtgtttcagcagggaagagtgagaggaagatttttcatgtttgtggagaatggcttaagagagttaaatgagtctttcaaagtgagtagctgattgaaattgagctaaactcagagcataatagtttagatagtctaagaaattg

SEQ ID NO: 65018 - DNA, 3612 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatatttta

SEQ ID NO: 65019 - DNA, 2511 bp, Homo sapiens
gggatacgcggatgagggcctgagcgtagtgagaattatttatagccaccacacccagcatatatgatctttttcttaatcctattcactttcatgattattaagattattataaatttattgtagaagtacagttatatgtgtaaatgtagaaatataatttttagtaacacattcacgacttggtgtcaggcgaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatatttta

SEQ ID NO: 65020 - DNA, 3657 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttata

SEQ ID NO: 65021 - DNA, 1760 bp, Homo sapiens
aaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatatttta

SEQ ID NO: 65022 - DNA, 914 bp, Homo sapiens
  misc_feature (5)..(5): n is a, c, g, or t
  misc_feature (12)..(12): n is a, c, g, or t
  misc_feature (21)..(21): n is a, c, g, or t
  misc_feature (28)..(28): n is a, c, g, or t
  misc_feature (32)..(32): n is a, c, g, or t
ctgcngtcgctntgatgattnccctcangccncgcactccagactacggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatatttta

SEQ ID NO: 65023 - DNA, 3717 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggatattacttttttggtccctattaaactatgtggcagcaagtcacaaaggaggaatcagaaagtaacctgctccccacccttggtgtgtagtccagttagcaaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatatttta

SEQ ID NO: 65024 - DNA, 3558 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaatcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatatttta

SEQ ID NO: 65025 - DNA, 3371 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaaattattaaaattttccaagaaaattaaatggcatttccaaaaagttaattattattccaaaattccaagggaactttggtttaactt

SEQ ID NO: 65026 - DNA, 632 bp, Homo sapiens
ctggaccacctcgaccgagttccacctctgccaaaaaaaatcagtgattcattgctgcgtaaggaataaaatcaaactctttagtttatgtgccgaagctcctctgtgggctcctctgtgattcacatctggtcacacaccctacattccagccatcacaaattcctcatggtaatccaaatagctcagccctttcagttactcacttagcccttcagcttgaacctgggtataaacttctccttcaaaagccaacccaaaaggtatccctttcctaaagacttctccaacctgttttctattttatgaattaaaacctcttccttacaccgaaaatattgcatccctatacaacagcattttttttactgctttatatcatagactctcatctacatacacctcccccgaaaaaatgctattccccatctgaattcttgaccatagcatctttgagcacaatgaaatgtgttgtagcgtcccctaagtgtggcaatgattggttaactgattggttatacaatacagagataactgatacactaacttctccttccccttgccttattttttaggttctgcacctggttttctgaacttttttccctaaaccctggttctccttgaatctg

SEQ ID NO: 65027 - DNA, 469 bp, Homo sapiens
aaacaggtgccgtaacagtaaaggggccccataaatgggaaacccaggaggcctctcagagctggacagctggtgcgaaagggagggttacagacctaagtggtccccagacttccggagtctgctatccttcacctcacacactcttaaacgtccatttgcctccaagagcacacacacaccccatcccttaataccctagttttctatcctcttgggtaaatattaatacttttctctctttttttttttcttttggagatagacttgctctgttgcccaggctggagtgcagtggtgcgatcttggatcatggcaacctccgccttccaggttcgagcaattcttgtgtctcagcctttcaagtagctgggaatacacgcatccaccaccatgcctgggcaatttttgtatttttagtagagacagggtttcatcatgttgtccaggctggtcttgaactcctggc

SEQ ID NO: 65028 - DNA, 1154 bp, Homo sapiens
  misc_feature (1)..(1): n is a, c, g, or t
  misc_feature (4)..(8): n is a, c, g, or t
  misc_feature (12)..(13): n is a, c, g, or t
  misc_feature (16)..(16): n is a, c, g, or t
  misc_feature (34)..(34): n is a, c, g, or t
nccnnnnncccnnctncttgggaggctgaggcangagaatggcgtgaacctgggaggtggagtttgcagtgagctgagatcgtgccactgcactccagcctggccgacagagcaagactcttgtctcaaaaaaatatagaattaaactaaattaaaaaataaatggaaccacccagcccatcccctacccacctgtcctgcattttttttctccttatcactgtctcaccactagaggccagctccaccagggcaagggtttttccctgcctgccactgtatgccgagtgtccagaacaaagcctagcacaaggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65029 - DNA, 1791 bp, Homo sapiens
ccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65030 - DNA, 1880 bp, Homo sapiens
ccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacaggtgagcgccacccacttacctgcctgggggccctggccctgagtctgcgctggggcccccaaagcccagccgagctctgatcgttgcagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65031 - DNA, 2034 bp, Homo sapiens
tgcgcctcggagctggcttcaaccagcgaaggctgaacccgcttccagggtcctcgccgagctgggagttaggatccgagggggccaagagggataagaaaacttctctgggtgcccacgtggtactgagcgcccttgggagggctctggagaagaccatcgccttccagggtagctccctccctcaaaggtttgagatcatggtccagttctcgggtctcccagcctcagtttccccatttgtaggaaaggcgttcacagcctctatctcagaggaggctttgaggattcagagagctcagaagaggggaaggaaactgaggtccagaaaagttatgactcgccccaaggggattgcctggcaggacgtgaaggggaagaggcccaccctggagtaaccctcactggagaatccagagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65032 - DNA, 1916 bp, Homo sapiens
tgcgcctcggagctggcttcaaccagcgaaggctgaacccgcttccagggtcctcgccgagctgggagttaggatccgagggggccaagagggataagaaaacttctctgggtgcccacgtggtactgagcgcccttgggagggctctggagaagaccatcgccttccagggtagctccctccctcaaagggaaggaaactgaggtccagaaaagttatgactcgccccaaggggattgcctggcaggacgtgaaggggaagaggcccaccctggagtaaccctcactggagaatccagagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65033 - DNA, 1897 bp, Homo sapiens
tgcgcctcggagctggcttcaaccagcgaaggctgaacccgcttccagggtcctcgccgagctgggagttaggatccgagggggccaagagggataagaaaacttctctgggtgcccacgtggtactgagcgcccttgggagggctctggagaagaccatcgccttccaggggaaggaaactgaggtccagaaaagttatgactcgccccaaggggattgcctggcaggacgtgaaggggaagaggcccaccctggagtaaccctcactggagaatccagagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65034 - DNA, 1667 bp, Homo sapiens
aattcggctagtacgagcctggtgtgagtcggacgagggtcggaggagggcgacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65035 - DNA, 1958 bp, Homo sapiens
ccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacaggtgagcgccacccacttacctgcctgggggccctggccctgagtctgcgctggggcccccaaagcccagccgagctctgatcgttgcagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65036 - DNA, 1665 bp, Homo sapiens
ccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcagggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65037 - DNA, 1097 bp, Homo sapiens
  misc_feature (1)..(1): n is a, c, g, or t
  misc_feature (4)..(8): n is a, c, g, or t
  misc_feature (12)..(13): n is a, c, g, or t
  misc_feature (16)..(16): n is a, c, g, or t
  misc_feature (34)..(34): n is a, c, g, or t
nccnnnnncccnnctncttgggaggctgaggcangagaatggcgtgaacctgggaggtggagtttgcagtgagctgagatcgtgccactgcactccagcctggccgacagagcaagactcttgtctcaaaaaaatatagaattaaactaaattaaaaaataaatggaaccacccagcccatcccctacccacctgtcctgcattttttttctccttatcactgtctcaccactagaggccagctccaccagggcaagggtttttccctgcctgccactgtatgccgagtgtccagaacaaagcctagcacaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65038 - DNA, 443 bp, Homo sapiens
gaatgtatgaattactttaacaaatgaatcagtgaaccaacaaacaaatgcactaatgaatgaacaaatgaattaacgaataaatgaaccaaaaaaatggatgagggaatgaatgaatgaacaaacagctgaatgaacaaatgaataagccaactgcagccccactgacagaaggtccgttctgggtgcccggatgtgcccctttttgcccgtggctctacacggcacacagtgggtgctcagtgaatttttgtcaaatgacaccattgggtggaaggaagcaggcagaggcgacagggctgtcctggtgcacagccacagcctcctgactcctgcccaccgctccctcccaggttccggatgaaatgccacctctgtgtcaactacatcgagatgcagacggaccccgccaactgcgactacgtgatcgtgagtggcgccca

SEQ ID NO: 65039 - DNA, 595 bp, Homo sapiens
tgcgcctcggagctggcttcaaccagcgaaggctgaacccgcttccagggtcctcgccgagctgggagttaggatccgagggggccaagagggataagaaaacttctctgggtgcccacgtggtactgagcgcccttgggagggctctggagaagaccatcgccttccagggtagctccctccctcaaagggaaggaaactgaggtccagaaaagttatgactcgccccaaggggattgcctggcaggacgtgaaggggaagaggcccaccctggagtaaccctcactggagaatccagaggtgagatgagccttgtacctatctcagcagagggagtaggataatatttaaatattaagggtggggagaaggaatgaaggcaagaaataaaatgcccaaaatgccccaaacgccatccggaccataaaagtgatggcgatagtgttggacttaggagctcaaagatgctaaccttgacaggcctggtggcccaagtctgtagtctcagctacttggaaggctgaggcaggaggatcgctttagcccaggagtgccaatccctcctgggcaacatagtgagatccttgtttcctt

SEQ ID NO: 65040 - DNA, 1943 bp, Homo sapiens
ccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactgtgcgtaggaggccagggggaaaaggggacagggaggctcagagttgcctggagatggggggtcctcagccatgagtggactctggtctaccagagggcagttctggaccccctcccctgccgcccctgaaatgtcctctcctctcctctagcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65041 - DNA, 1675 bp, Homo sapiens
ctggtacggtccggaggtcggtaggatggcacggtcagggcgtgacgtcgggaggagggcacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65042 - DNA, 2078 bp, Homo sapiens
atggtggctcacacctgtaatgccagcactttgggaggttggggcgggtggatcatgaggtaaagagatcaagaccatcctgggcaacatggtgaaaccctgtctctattaaaaatacaaaattagctgggtgtggtggcgcacgcttgtagtcccagctactcgggagactgaggcaggagaatcacttgaacccaggaggtggaggttgcagtgagcagagatcgcgccactgcactccagcctggtgacagagcgagactccatctcaaaaaacaaaaagatcccctgggcagctgtggggtgagcaagtgtcaagggcagagtcgggagagagaagaccgtgctggcccacgtgagtgatgatgggtgctggacccggtgggggccacagagggatgaaagtgtcagatgtgatgcgtatattggctgtagagtggacgggactctctctttctaaacaacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65043 - DNA, 1587 bp, Homo sapiens
ccactccggcgtcgcagaacgcttggcgtatcgtccttcagccaatcagcgtggagctgctgcctcgccccgcctcacgccggcgtcctgggggcgcggagagggcgcccaggttcaccgcgctctcagcgcgcacttccgggcacggtcagggcgtgacgtcgggaggagggcagggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccgggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65044 - DNA, 1220 bp, Homo sapiens
gtagtactggatacttgggaggctgacatgagagaatcgcttgagcccaggagttcgaggctgcagtgagctatgattgtgccactgcactccagtctgggcgacagaatgaaactgtctcaaaaagagtaaatgagaccccgagagttggagcagtgccccctagtacacagaagagacagggctttgacaccccctatctctggtgttcttggccctcaacacaggaaaagaaaaaagccatccaggaggaggaggagagagaccaggccttgcaggccaaggcgagcctgaccatcccgctggtgcccgagacggaagatgaccgcaagctggcggctctgctgaagttccacaccctggactgtgcgtaggaggccagggggaaaaggggacagggaggctcagagttgcctggagatggggggtcctcagccatgagtggactctggtctaccagagggcagttctggaccccctcccctgccgcccctgaaatgtcctctcctctcctctagcctacgaggacaagcagaaactcaagcggaccgagatcatcagccgctcctggttcccctctgcccccggatccgcctccagcagcaaggtcagcggcgtcctgaagaagctggcacagagccgcagaaccgcgcttgccacctcccccatcaccgtcggggacctgggcatcgtgcggcggaggtctcgggacgtcccggagagcccccagcatgcggccgacacccccaagtctggggaaccgcgggtaccagaggaggctgcccaggaccggcccatgtcccccggagactgtcctccggaaacaactgagacccccaagtgcagcagcccgagggggcaggaagggagccgtcaggacaagcccctgtcgccagcaggctcctcccaggaggcagctgacacccccgacacgcggcacccctgcagtctcggctcctccctcgtggcggactactccgactcggagagtgagtgagcgatccccatcctggagactggacccgctctagaggcccggacacacccaggaggcccctcacagactgcagacccccggctcgcccaccagccctgggagagctcagatgccgcatcctccccagaccgcgccttcctgcaaccgtggagttatttatttggtcctggtgagggtgtttgtgccttgtgagactccgtacattaaagacctgtctcttctt

SEQ ID NO: 65045 - DNA, 949 bp, Homo sapiens
cggcactaggattttaatctttacaacaaacccttaaagaaggcaaggcatatgaaattacccttgtattcagtaaactgttgaggtcaaggtgtttattaagacccatgccttctggatagactaacagggatcaaaacaaaaactgactcttagtcaataagtcaaacacttttgattcctattacaagtaaccatttttatattaatatatacttattggccacccttccttcttttgtgaaatgcctattcatttattttgcccattcaaaatttggaaagctcattatgttggtactgttttgtaagggctctctataaaatatattttatttcttttacttttttaataatttgaactttgactttgttttattaatttattaacaaattttaattcaaaataagtgaatattaattccatatctggcaacaggtggactagatgtctggcgaataacacctaatataaaacacctgtcacggtgattgaaaaaaatcaacagctatctcattaaatgcatggcaagtaaaatatatcttctggggccaaaaatagaccagaattatctgctacttgaatgtttggcaaaactctcctagaaaactgagtctgatgtttgatttgtgtaaagacttctttaacttttctaactcaatttttactaagttataggactactcagattttgtttcttttttgctcaattttggtcaattttgtttttgtctatgtcacctaagttttcaaatgtattggcatgaatattttcataatattcccttattatcttttacatttctgggatatctttagcgatgtttccctttttatccctaaaattgtttattcatgctttcttttttcttaatcaaacttgttagagatttgtcaattgtactcggtgttcaaaaaataaatcttggctttgtgagcttcaaaatt

SEQ ID NO: 65046 - DNA, 677 bp, Homo sapiens
aaaaacacatctatacatagcacttgtctaaaagctctttcgataactctgtgtgtgtgtgtgcaggcacatgcgggctcattcagtcttcatgataaccctaggaggtgctattactgttcccattatataaataaaagaaattgaagcacggagaggttaaataaccaaatcaaggttacacatctactaaaagagcattagtcatcacacaaaaaaagtaatgaaataaagaatttgtttttctctttggcttatcttatggagattatgacaattaccaaaatctttattacctagaatcttttatttggtgacttatagtttaagttccaaagaaaaatattgccatataaggaaagggtatgacatagaatacacctgaaagagagttttcttaatatgactcgtttgtgagataatttctggggctaccacatccctggttttacactagagtccagtgacctgaacctccaatactgaagtcactaaattttcttcacaaaataactgtatcctactagcatcaagacagcacattacactgccatcttgcctccatccttgaaattttagaaagcaaaatatggcctcatacaaatatcatttggaattctgaaactgcaaagatacccaggactcaaatgtttaaaaacccaaatgcatttctaagt

SEQ ID NO: 65047 - DNA, 400 bp, Homo sapiens
aaagtcataatgcaactttgtctatttttattcttcacatagtgactatgtcttgtttaacagaatttgaacatattaaaatagatgaccaaatactaaatatttagactatgtagtggaacacatgatttatatcagtcatttcttgaaaacttatgagtacttcattgacattacatgcataaagcaaatatctagctgaaacattgctgaaaaaaaaatacgtcattttgccagtaaattaaataaactgcagaaagaaactacttctcaacatgaaagtaaagagaagagaatcaaggcaatgggctttgccacagacagggaatacacagggaacagggaaaggatcaggccccccttgcttgaggcttgctttcctcatctgtagatttagggg

SEQ ID NO: 65048 - DNA, 2505 bp, Homo sapiens
  misc_feature (1302)..(1302): n is a, c, g, or t
gatttgctttgggagccagagtagctggcgcaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgttgcaccgccaccgccaccaccaccagcagcagcagcaccaccggctttgccttgaatttaaaaccactggcgccagccgggatccccagcaatacagcagctgccgtgaccgctccacctggccctggcacaactgcaggggcggctgcaagctccgccatgacctacgcgcacgtggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtgaagaaggtgaagctggaccagaagaggctggaccaggagctcgacttcatcctgtcccagcagaaggagctggaagacctgctgagcccactggaggagttggtcaaggagcagagcgngaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcaagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccga

SEQ ID NO: 65049 - DNA, 1885 bp, Homo sapiens
gatttgctttgggagccagagtagctggcgcaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcaagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccga

SEQ ID NO: 65050 - DNA, 165 bp, Homo sapiens
aagtactcccaggacaagccagtgtcagagtagggggagctagacatggagggtgaggccagttgaaactgacctgtggggggctccggagtataagttacacctcagagtttgtgcccaactgcaggccagggatctgggcttctatgcttctgcatgtgcacc

SEQ ID NO: 65051 - DNA, 691 bp, Homo sapiens
tgagtgtctcactttccctttgaatgttctggaggcatcccacatcatcatgtgatcacaattactcacctgcagctgtggcagtgggcaccccatttataccctatgaccatttcagtacagccagcccaacttccaagtctactttcttctcctgaagctctttctggcctctaaaggcagctttgcccatacatggagcagatcagaagtgaaaagaaccggctttctctgtggttataacttgatttgcaaacggcaagtgaaaggcagttctccctgaaaagaatcctgttcatgcatcacccaggatcctggaacagctgcctcctctctaagcagaagagccctggtggcctctgtgcatgaagaccatttggggcctaatgaagtgcaaagttgggaaattcagctcctaaccaactcatcaccagaaacacagtggcagacagctgttagggccgaacattatcatcatcataatacctatcacggagtgaacccctgctatgtgccaggcactgtccaggcatcttcactaagattacagcctttgacactcactacagtctaatacagtgtaatttcttgccttcattttctagtggaggagagaaaatgggatttccccaaagatgtactgctgtaagtggtagaatcaagatttattataaaatgaggttgatctgat

SEQ ID NO: 65052 - DNA, 584 bp, Homo sapiens
tgagtgtctcactttccctttgaatgttctggaggcatcccacatcatcatgtgatcacaattactcacctgcagctgtggcagtgggcaccccatttataccctatgaccatttcagtacagccagcccaacttccaagtctactttcttctcctgaagctctttctggcctctaaaggcagctttgcccatacatggagcagatcagaagtgaaaagaaccggctttctctgtggttataacttgatttgcaaacggcaagtgaaaggcagttctccctgaaaagaatcctgttcatgcatcacccaggatcctggaacagctgcctcctctctaagcagaagagccctggtggcctctgtgcatgaagaccatttggggcctaatgaagtgcaaaggtattttgtgctctggacccaggagtgcaacagttactggctgctgaaggcagacattaaggagaaccattttaattgattagaatgtgcatatgctgtattggtttcgtctgagggcattttggaacaaatagcactgtcattgtgagccttaattagataataaattaatagataaatggatt

SEQ ID NO: 65053 - DNA, 310 bp, Homo sapiens
ggcgtgagccactgcacccagcctcacgttacattttcatagctagcagggtaatggtggagttattggcactcaggtcacattctagggaatgtttattgggcaatctcaatggcaccgcaagctaaatgacttccagtgtttctcgtctttgtgctttcttcattgcaacctttgcccaagacatctgtttcttctggatcacccttgtacagccactgatggaatgatcttctgaaagtgaatcttcagtagacacattggccacaccatctttgccagccatcacattgcccaggtctccgacatg

SEQ ID NO: 65054 - DNA, 612 bp, Homo sapiens
ccagggacacaatacactgtggaaggctacagggacctctgcccaggaaagccaggtattgtccaaggtttctccccatgtaatagcctgagagatggccttgtgggaacggaaagacctgaccatcccctagcccaacacccataaatggtctgtgctgaggaggattagtgaaagaggaaggcctctttgcagttgagataagaggaaggcatctgtctcctgctcgtccctggtaatggaatgtcttggtgtaaaacctgattgtatgttctgtttactgagataggagaaaaccaccttagggctggaggtgagacatgctggcggcaatactgctctttaatgaactgagatgtttgtgtacgtgcacatcaaagcacagcacctttccttaaacttatttatgacacagagatctttgttcacatgttttcctgctgaccctctccccactattaccctattctccggccacatcctcctctccgagatggtagagatagtgatcaataaatactgagggaactcagagaccagggccagcgcgggtcctctgtatgctgagtgctggtcccctgggcccactgttctttctctatactttgtctg

SEQ ID NO: 65055 - DNA, 382 bp, Homo sapiens
attcgtccttcagtctacgcttgaaattgccagggatggataaatctgaagatgaatgaaaaaaagaaactactgggaacggaacagaaacaaaaaaaaaggatgggaaatctgaagctgctatttcttattctgatcttaatagcaggatacagttgaataataacattatctattggagatcactgaaatgtagggagggaattccattttgaaaactttaatatgtagagagtcagtacatcattttcacaagcaatatccttagaagaaaggattttttttagaactatcatgctacagaaaactgcatttttatagtaactgaaagatgcaaagttactgaaaaaataaaactgccattttattgtattgccattaa

SEQ ID NO: 65056 - DNA, 339 bp, Homo sapiens
tcccacaacgggaggaatggatgtaggccgggccaggccccagcagtcctgggggctcaggcacttgccgtggcctcttgaagagacctttctcagaatcccccaggaaagctttatgaaaatgccagggccacagcatcccagccccggagagactggcttagtggagctaacagccttgtgtattttgaatgctcccagtcagtagtgatggacgcccattgagatctactggcttagacaaggcagagcgtgtgcagctggccctggggtcatctccccaggcttgcttggctgtgtggagaaggaggagcagacgaaacaaaacttaggggcctg

SEQ ID NO: 65057 - DNA, 428 bp, Homo sapiens
ttgagaaaaagattaagactaatttgtccttaaatattgacatgttttgggtgcaatctagagttgggaattgggtccatcataatactgttttaaaaatactttgtgtagaatcatgctctttccatatacttttcatttgcccctcacaagaactctgcactagcagggcaggtatctttatttgactattgaagaaacaaatttagagagtttgtaaatttatttgctgagtcgcaaggccaagactcgctcttctaactctactctttttgttacacccagaacttgagacactcctctcctaggcagcttcgtgttagtgttagtcagtgcctcttaggtcaggtcagattcagaaaccgcaattacttttgcaccaacctaatagttttaggtccagaaggaatcttagacatcattttgtg

SEQ ID NO: 65058 - DNA, 209 bp, Homo sapiens
cgagactccatctcaaaaaaaaaaaaaaaaaaagaaaacctaaacttgaaaaaagttaaaagttaaaatatactgcaaaaaataataccccaagaaaggatgtgaaacagtcagtcttcagttagaatttctgacatggtactgggaacagccatctgtgaaggtcatggctctaccaggccaccattctatctggggcactgacactg

SEQ ID NO: 65059 - DNA, 411 bp, Homo sapiens
ctgttgtccaggctggagtgcactggcatgatctcagctcactgcaacctcttccttccaggtacaagtaatttctgcctcagcctcccaagtagctgggattacaggtgtctgccaccatgcccagctaatttttgtatttttagtggagtcaaggttccactatattggccaggctagtctcgaactcctgacctcaagtgatccaccctccttggcctaccaaagtgctgggtatcatgttatttttaaaccatagcattgtcacacattccttttttattatatctgctcgattcagtctgacaaagactactattaggtatccacccaatatccattcttttcttattccttgctaaacaaaaacacctatgttattggggctgggagtgtgctcagttaatataa

SEQ ID NO: 65060 - DNA, 506 bp, Homo sapiens
acatacttctcctttaatcccagagttagtttttaaaactacatgattgctgtttttgcatattaatagtactctaaaattatccttgcctatgtgcagaaatgggtaagggccacttaaaccaaaatggagttagttatgttagctcttgtgctgtttcactgttacactgctgctgtgctgacactaagcagagtttcagcttcactaatataatttgggtgagagtgagaaatggtttaacagttaaatcacatcagttgattgagaaagtaaatctgagaaaaaaaatgcattgggatgcgagtccatttgtcaagtcctggttggattgccaccatatgttggctacggataaaagttgaccataaaaatcagtgaaagaattctgtgagaatcaattgacctaatataatttacaatagagagtattgtatgttttattatttgtaaattgttactcatcttttatatcagtaaattcttaatttatgtacgtaaataca

SEQ ID NO: 65061 - DNA, 1173 bp, Homo sapiens
tttctgtctccgcatcttttcaaagagaggctggcctgtgcttttgagaactgagagttagcatgggttttgtcagatattgagtagatctctgttcaagtgtctcaggcttgggtggatgtagacggtaaacttctcggtgtgttgtttcatctgccaggttctaggacaatcagggaagtgtggagaaggtcacgctggttggcagcagccttgtgggcagggctgctcctctgcgggccccacagctggcaggggtcaggtgccttccctgggctcacaacccctctgcacaccccatagctggctgggtcaggcgccttccctgggctcacaaaccctggggcagcaggcaggctcgggctgtggttgtgttctggggtgtgagaagggatgaggtactgctgcctctgggaagctcccagcttgttccagcctcctgcctgcccctctgtggctgacagtcgactcccctggagtcactgccctgagtctcaagggtacttctctgcaagctccaggccaccaatgccaccagaaatctctgaagtcgctccagtggcttaaccgcatcacaaagtcaccagactggataaagttattccgctgacctaaagcctgtcagatgtgctggcccctccccgacagggtgcaccggggcaagctggccaaggctccttcaccagccacccccgaagtcactgctgaccacctaccgcatctcaacacggggccgggcagctcgcaccacggggctcctgcctagggctgcacccctgcctcagagcttcccgttcctctcgcaacaccagctgaacgcctctactccacagaacctccctcccgcggggggagcccactgctgctccacgaggttcctggctaagggcctgctctggcctttgcttctgtctgctttttaattacactgactttgtatttttacgtgcctgtctgtcctgtgacatcaaagtcttgctccaagaacataacaaagtaactgaaatcgagtgagtgaagtattgcctggtagagattctcaaggaatctgctttgacaaattaataaatgaatttcactggtacaacagtttgcatataaatagtttcagaagtcccagggagtacaaaggattatttgaaactttctgtacaaatgtccagtacactgaac

SEQ ID NO: 65062 - DNA, 1589 bp, Homo sapiens
tttctgtctccgcatcttttcaaagagaggctggcctgtgcttttgagaactgagagttagcatgggttttgtcagatattgagtagatctctgttcaagtgtctcaggcttgggtggatgtagacggtaaacttctcggtgtgttgtttcatctgccaggttctaggacaatcagggaagtgtggagaaggtcacgctggttggcagcagccttgtgggcagggctgctcctctgcgggccccacagctggcaggggtcaggtgccttccctgggctcacaacccctctgcacaccccatagctggctgggtcaggcgccttccctgggctcacaaaccctggggcagcaggcaggctcgggctgtggttgtgttctggggtgtgagaagggatgaggtactgctgcctctgggaagctcccagcttgttccagcctcctgcctgcccctctgtggctgacagtcgactcccctggagtcactgccctgagtctcaagggtacttctctgcaagctccaggtatgctgccttaccctgacctatagacagtacctctccccgggtttctagagcagtaaccattttcctcctctacttattacattcctttgattatcccagtgagagtatgcgggtggccgggaagggtgagagctggatcacttgtgctcaggtaacctactcgaatgagaggcccaaagacacatatagtgaattgcctagttagcggttcatccacatggatttggtttcgctgaatgatcaccattctcatacaacaaggcatctttatgcaaaggacggtcctcttatcaccccagcccacttcctcaatctcttgtctccactctgcctttccttctgacccaagagctgtcgcctcgccccactgccacacctcaccccactgccacacctgtcacactccattccaggccaccaatgccaccagaaatctctgaagtcgctccagtggcttaaccgcatcacaaagtcaccagactggataaagttattccgctgacctaaagcctgtcagatgtgctggcccctccccgacagggtgcaccggggcaagctggccaaggctccttcaccagccacccccgaagtcactgctgaccacctaccgcatctcaacacggggccgggcagctcgcaccacggggctcctgcctagggctgcacccctgcctcagagcttcccgttcctctcgcaacaccagctgaacgcctctactccacagaacctccctcccgcggggggagcccactgctgctccacgaggttcctggctaagggcctgctctggcctttgcttctgtctgctttttaattacactgactttgtatttttacgtgcctgtctgtcctgtgacatcaaagtcttgctccaagaacataacaaagtaactgaaatcgagtgagtgaagtattgcctggtagagattctcaaggaatctgctttgacaaattaataaatgaatttcactggtacaacagtttgcatataaatagtttcagaagtcccagggagtacaaaggattatttgaaactttctgtacaaatgtccagtacactgaac

SEQ ID NO: 65063 - DNA, 540 bp, Homo sapiens
agaaatgaaaaagcaatcatattatgctgcagtggctcacatgtgaggtaggggtcatgatatatttttttttcctatgctgatattcttgttgcagcatcgtttgcagaaaagactgtcctttcactcttgattggttttgaaatctttcctgaaagtcaattgcccataaatgtataaatccaatactagcatctgtattctgtccattgatgattatatctatccatatgctcataccatactgtctttattattgtaagttttgaaacctggcgtgacaaggttttcaactttgttattctttttagaatttattttgggtattctaagtatttagcatttgcacataaatttttgaatcagtttgtgagtttcaacaaaaagcctactgggattttgatggagattaccttaactctacagttagatcattttgaggaaaaatgacatcttaaaaatgttgactcctttagttcatgaataaggtatatctttacatgttttaaaatttctttagcaatgttttatagttttcag

SEQ ID NO: 65064 - DNA, 387 bp, Homo sapiens
tgtatggtttatttgttcattgttttttttttaatcagctgaatttaagattcaaagatcctgtctttaattcttttggatctatacccagaagtgggattgttgggtcatatagtacattttatttttaattttttgaggaccccccgtactgttttccagagcggcctcatcattttacattcccatgtgcaaggcacaaaggtcccaatttcaccacattcttgtcaatacttgttattttctgtttatttgatagtggccatcctaacaggtgtgaggtaatagctcattatggttttgatttgcattttcctaatgactggtaatattgctcatattaccatatgcttgttggcatttgcatatctttttctgagaaatgtc

SEQ ID NO: 65065 - DNA, 332 bp, Homo sapiens
atgtcaaataggtatgagtagaaatctcaaagggtgaaagatacagctgtttctagaagctaacaatttgaaggattaatctattacttgctgaaactgaactttcttttccaattagtcagacttttaacatccaggcaaaacattccatttccctgaataaaacaaagtaaatgaaaaaaaaaatgttagcactcattagcaaatgctcaaaagattttctgccttctttgaagggaaaaataatgtccttgattttgagtgattttgctgtgatctcatcagtagtttgaatacaggctctaattaaagacatagtatcatatatttga

SEQ ID NO: 65066 - DNA, 315 bp, Homo sapiens
aggcagagagtacttgagacctcatggatataaaaccagcttacaaactacattgcactatatgaagaaattatcactgggggcaaagcaccaagcagagagcacagtacacagtgtgtggatgttaatgttattccctagccttcccattcctttctcttggtcctttatgcatatggaacggttccattattaaactttgtaataataactgagaacctgactcccagcaagggagtcgttcagaagttgagggagttgaaatctgactgagtaaataaaacaattaaatcattagcttaacatttcatcaat

SEQ ID NO: 65067 - DNA, 792 bp, Homo sapiens
ccctaaatgaacactggtaggctaaaaggcaacactggcgtacacgcaggcttttctcttcccactatgcaatacttactaagatctaactattgtgttctcaaacctacttaatgccggtggctcataattacaattacataattgtcatgaaatattaatactggctgggcatggtggctgacacctgtaatcctaatctttattgaatgcttactataggccaggaactatactaataatgcaattttatatgcattatcaaaaatcttcacaaaaactctgttaggtaaaagaaacatacttctgaaacaaacaaaaagacaaaaataactagagggaagattaaggaggtcataccaaatgactgcaactttttagttatggaaacagaaggaaaaaaaagcaggaaggcttgagggcttgagaggaacagataagaaactaacatttactgcctactatgtgccagccactgtaacatccattacatacatgtcatgtaattctgtgaagtacttatcattcatttaactgaagaacttgaggtttgcgagtttcccaagaacaaagagctggtaagtggtgaggtggtgattcaaacctagctccatgaaactacaaattatatttctttctgctatatcaacatcaggaatgtgctagagaataaatatgagatgaataaaaagatcataaagcagcaaaggcccagttaaaatcacacagcatgaaattagagcagataatgccaactctgtgccctctgctccctgagttcagccacccagg

SEQ ID NO: 65068 - DNA, 260 bp, Homo sapiens
  misc_feature (26)..(26): n is a, c, g, or t
ttctatctgcaacgactctcttaatntccaccgctcaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagatgctgatagctccagaacc

SEQ ID NO: 65069 - DNA, 593 bp, Homo sapiens
ggctattttttcctttattattatttttcttaggtccatgaaggttcatattgcaagaagtccacagggtatagagcaatgtggctccctctttctcttccccagagggagctgctgcatggtttccgtgtgctgtcttccactttgctgcatcttcacttcagggaggcctgcagtctgcagccctcttgggacccgagggcaccactccctgttggaacagaagagtcagttctggcatcagcagtatcactctgtagctgggtccaggcagaggggacatgggccaggaggatttattccaggctgtaagatgcccaagtgcagggcagctggagaagcccatgccgagagagcaggcagtgcccacagtcctcctttacagggtgtctactggatctcatgtcaaagcaccaagatgccaggtggcttgatgatgcctggggagccaccatggcactcaaggggaaagggtctcactccacggggagacctggagagggacatcccctatccaaccccttctgccaggtctagcccaagccttccccaggagggttgagaaggcggtgacaacctcaactacagcttct

SEQ ID NO: 65070 - DNA, 617 bp, Homo sapiens
gaagaagtggggtgacttaggggctgagcctcagcaactgggagagtttataagctgggatagcagacccctcagcaccacccattctcctcatccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactctcgatgcggccggaaaacaacctgtcaaaacacctacccgaagcagaacagcaaaa

SEQ ID NO: 65071 - DNA, 609 bp, Homo sapiens
gaagaagtggggtgacttaggggctgagcctcagcaactgggagagtttataagctgggatagcagacccctcagcaccacccattctcctcatccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaacgcgcccaactccctctcttcctacacactaaacgaccccaccatacacac

SEQ ID NO: 65072 - DNA, 1311 bp, Homo sapiens
ggctattttttcctttattattatttttcttaggtccatgaaggttcatattgcaagaagtccacagggtatagagcaatgtggctccctctttctcttccccagagggagctgctgcatggtttccgtgtgctgtcttccactttgctgcatcttcacttcagggaggcctgcagtctgcagccctcttgggacccgagggcaccactccccatcatcctgttgttctttacagcacttttgactttatcttcttaattcctggagggcagggacctcacgtgtttcttctgtatctccagggcccatgtgtctggcacacagtgagcagtcaataaaatggattgaatagacaaatgaatgaacaatgagatggtctccagagcccctcccagcgtgctggctttttgtgtcattgcagactttgcacctctggctccagggagctcacaggcaggggctggtccagcccagaggcgatgaagacagtgacgatgatgatggtggtggagatgcaggcgctgactcaggttctgagagctgtgttgtctgcgtgcacatgggtgagccggaaaggagacctgcagagaatgaaacagacacataaaggaaagaggacattctcacaagatgggtaggccggagtgatcacggaggagatagagtccctgcatgtgaagtggtactgagagacacagcaggaaatggaagtcaagattctgaacccctaaccccttccagctctgaagcttgaacaaaataaaactcatccagcatccagcccagtgcctggtgcacaggcatcttcaaggcacctggcaccttctcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagatgctgatagctccagaacc

SEQ ID NO: 65073 - DNA, 1091 bp, Homo sapiens
ggctattttttcctttattattatttttcttaggtccatgaaggttcatattgcaagaagtccacagggtatagagcaatgtggctccctctttctcttccccagagggagctgctgcatggtttccgtgtgctgtcttccactttgctgcatcttcacttcagggaggcctgcagtctgcagccctcttgggacccgagggcaccactccccatcatcctgttgttctttacagcacttttgactttatcttcttaattcctggagggcagggacctcacgtgtttcttctgtatctccagggcccatgtgtctggcacacagtgagcagtcaataaaatggattgaatagacaaatgaatgaacaatgagatggtctccagagcccctcccagcgtgctggctttttgtgtcattgcagactttgcacctctggctccagggagctcacaggcaggggctggtccagcccagaggcgatgaagacagtgacgatgatgatggtggtggagatgcaggcgctgactcaggttctgagagctgtgttgtctgcgtgcacatgggtgagccggaaaggagacctgcagagaatgaaacagacacataaaggaaagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagatgctgatagctccagaacc

SEQ ID NO: 65074 - DNA, 593 bp, Homo sapiens
gaagaagtggggtgacttaggggctgagcctcagcaactgggagagtttataagctgggatagcagacccctcagcaccacccattctcctcatccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagatgctgatagctccagaacc

SEQ ID NO: 65075 - DNA, 611 bp, Homo sapiens
gaagaagtggggtgacttaggggctgagcctcagcaactgggagagtttataagctgggatagcagacccctcagcaccacccattctcctcatccctctgctctctggcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaacagatgcggccgagcattgaaggactcgcacaaatagtgaaatgagaagagtg

SEQ ID NO: 65076 - DNA, 1287 bp, Homo sapiens
tgtccttccttctattccttgcctgcaccatccccctagctttttaccaactgaggcgttatctgaaattcctctgcctgcttttctcagccccatgtcctaagcattaaggtgtccacaaagattcctttctcagacatgccttccctgcccaccccatctgaaaacgacctcttcaaatactggcccatcatcctgttgttctttacagcacttttgactttatcttcttaattcctggagggcagggacctcacgtgtttcttctgtatctccagggcccatgtgtctggcacacagtgagcagtcaataaaatggattgaatagacaaatgaatgaacaatgagatggtctccagagcccctcccagcgtgctggctttttgtgtcattgcagactttgcacctctggctccagggagctcacaggcaggggctggtccagcccagaggcgatgaagacagtgacgatgatgatggtggtggagatgcaggcgctgactcaggttctgagagctgtgttgtctgcgtgcacatgggtgagccggaaaggagacctgcagagaatgaaacagacacataaaggaaagaggacattctcacaagatgggtaggccggagtgatcacggaggagatagagtccctgcatgtgaagtggtactgagagacacagcaggaaatggaagtcaagattctgaacccctaaccccttccagctctgaagcttgaacaaaataaaactcatccagcatccagcccagtgcctggtgcacaggcatcttcaaggcacctggcaccttctcctccagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagatgctgatagctccagaacc

SEQ ID NO: 65077 - DNA, 461 bp, Homo sapiens
tttcccaaaccacagggttaaaagcagctcttatatggctactctgcttgtccccgggtccagggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagatgctgatagctccagaacc

SEQ ID NO: 65078 - DNA, 180 bp, Homo sapiens
taaaatataacaggtgaaatttaaaactcagtgaatagattagcatattagatagtgtagaagagaactagaagatctgaagatactgttcagattacagcacggggcgacaaaggacatgaaaactgcaagtggttaagagacatggagggtaagataccacgaaataactagaaagac

SEQ ID NO: 65079 - DNA, 577 bp, Homo sapiens
agataggtttattttctccttctctcctttaactattgtctactgaagtctttaagacttccttcatgggttttggaacacaaaagatttccttcttatcttcattggtctgtgaaggattctctcttctgtaatagatttttattttcttggtacattttcttgtaactgaaatcctcaagctaaaaaaggtggatggaagcacattttgcaaattcattctcatgtctctggcattgattcaaatctctaattgaaaaactagtttccaaggggcactaattaggtctcgagattgatgctttgtgcaaagtttagactttttctagtctgccacattatgtagtttccttttttcatcatctctagtttgtagctaaggaattttatatttctattggtctgggctatgggcaacaatttttatgcagtgattacttttatgtaagtgaaaatgttggcactttagaataaattttgacacatttccaatatctactactgtatctaatgaattatgtagcatttttcttaatgtgcttgagagccaattatatatttgttgtatattcatttg

SEQ ID NO: 65080 - DNA, 514 bp, Homo sapiens
gagacaatggttacttcttttcatggattctaaattctatctgccagtcactttttgtgtgtgcattcattgagggtgtacagaatggaattacagaggcagaaaaaaatgaggtctctgccaaattgatagtttaaaaaacattttagtggcctacttaactgtaatttgttttagttttaaacaagaaaaacctcagcatgtaagcaaagcagactggacttgaacagatatggaatgcaaagcacacaggagagtcatggggatcctgaagggggattagaagttggacaactttttatgcaatgaacaacactgcattgaggcagtggattaaacagtagtgcatatcacttggctgaagtgacaggaataaagaacagaatgcatccactcctccagtctcattaagctgcctctttctcctgaaattggattgggattccaggacacctctcaacctacaggaaacactggatctaaagctgaaacaggtacccagtgccatttgaaa

SEQ ID NO: 65081 - DNA, 585 bp, Homo sapiens
agcgggtgggcgcgagtcggcctcccgcggtgccgccgcagcgtggcgcggagaggcaggggcatccagtggttcaaggttacaataagctgtgatcgtgccactgcattctacctgggatgacagagtgggaccctgtgccacagagtgagaccctgtctcaaaaaaaaaaaaactatgtaaatccaagaaaaaaagaaaacagctcctgttgccttttgcctctcatccagaaaggtatccatttgcctttctaatatctcttcatcctgtcaggccacaaatggagacgactcacctgtattgtacctctccaagttctggaaagtcgatggagggtttactcagaacttcaatctatccagaactgagttttgtttatggtgtgtgccagaggcagtggattaaacagtagtgcatatcacttggctgaagtgacaggaataaagaacagaatgcatccactcctccagtctcattaagctgcctctttctcctgaaattggattgggattccaggacacctctcaacctacaggaaacactggatctaaagctgaaacaggtacccagtgccatttgaaa

SEQ ID NO: 65082 - DNA, 631 bp, Homo sapiens
acgctctctctgtggggggtttaaaaatatttaccactacccctctctcacctgccacaatgtgaagaaagtccttgtacccttcgccttccgccataatggcaggggcatccagtggttcaaggttacaataagctgtgatcgtgccactgcattctacctgggatgacagagtgggaccctgtgccacagagtgagaccctgtctcaaaaaaaaaaaaactatgtaaatccaagaaaaaaagaaaacagctcctgttgccttttgcctctcatccagaaaggtatccatttgcctttctaatatctcttcatcctgtcaggccacaaatggagacgactcacctgtattgtacctctccaagttctggaaagtcgatggagggtttactcagaacttcaatctatccagaactgagttttgtttatggtgtgtgccagaggcagtggattaaacagtagtgcatatcacttggctgaagtgacaggaataaagaacagaatgcatccactcctccagtctcattaagctgcctctttctcctgaaattggattgggattccaggacacctctcaacctacaggaaacactggatctaaagctgaaacaggtacccagtgccatttgaaa

SEQ ID NO: 65083 - DNA, 375 bp, Homo sapiens
ataacctttagttctaagcagggcccattagggattttaaaatattcacttttgaagctgattcctgcattggtagacactttgcatgacattaaataagctttgcctgttctaggaggcagtggattaaacagtagtgcatatcacttggctgaagtgacaggaataaagaacagaatgcatccactcctccagtctcattaagctgcctctttctcctgaaattggattgggattccaggacacctctcaacctacaggaaacactggatctaaagctgaaacaggtacccagtgccatttgaaaaattaactgctctattgaaatgtaatctacataccataacccagtacagtttctacccacaacaaaat

SEQ ID NO: 65084 - DNA, 1718 bp, Homo sapiens
gctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatta

SEQ ID NO: 65085 - DNA, 1992 bp, Homo sapiens
gctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatta

SEQ ID NO: 65086 - DNA, 1671 bp, Homo sapiens
ggcggagcggagccccgccctgggttatgtaagcgaccgcgctgggccgtttctctttcttttccggaccctgcagtggcgcctaaagtctgagagagggaagtcgcctctgtgctcgtgagtgcatggggtataagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatta

SEQ ID NO: 65087 - DNA, 1430 bp, Homo sapiens
gctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatta

SEQ ID NO: 65088 - DNA, 1397 bp, Homo sapiens
ggcggagcggagccccgccctgggttatgtaagcgaccgcgctgggccgtttctctttcttttccggaccctgcagtggcgcctaaagtctgagagagggaagtcgcctctgtgctcgtgagtgcatggggtataagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatta

SEQ ID NO: 65089 - DNA, 1377 bp, Homo sapiens
ggcggagcggagccccgccctgggttatgtaagcgaccgcgctgggccgtttctctttcttttccggaccctgcagtggcgcctaaagtctgagagagggaagtcgcctctgtgctcagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatta

SEQ ID NO: 65090 - DNA, 1665 bp, Homo sapiens
gctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatatta

SEQ ID NO: 65091 - DNA, 2649 bp, Homo sapiens
gcagctgatgctgtcggtgagtctagaggattccgggtatcgacagattgcactaattgtgaatttagattgtttatgatgctgagtatatagcgtgctcatgccaaaatcttgtagatgtcaaataaaaagttattatactaaacaagaagtggagtcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaa

SEQ ID NO: 65092 - DNA, 461 bp, Homo sapiens
gaggatccccctcggatcgaggtttcgtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatggtaagttcagtatattaaatatacacgaaagcatataatatttcagtatatttgaaaatgggatatgaaaccttttcttctgtacagtacaaatgatcacacagattataatctttgcttggtggaaagctccaggcttatctaccttctggaagtttgagcctcatatatgtgagaagataacctcaattttgtgcagttatttttaacttgaaaacatggatttgtaccccatgg

SEQ ID NO: 65093 - DNA, 5689 bp, Homo sapiens
  misc_feature (180)..(180): n is a, c, g, or t
aagatggcggcggggaggtaggcagagcaggacgccgctgctgccgccgccaccgccgcctccgctccagtcgcctctggtccttcaaactcacacctcccgggaggagctgtcctggcgccgggtcccgcggggaaaatggtggagccagggcaagatttactgcttgctgctttgagngagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggcgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttcttttttttctttttttttttttttgcttccacaggttgcactattgaaaaatcgagattgtataaacctggtaaaaagctgcaagatgccaaaatcttgtagatgtcaaataaaaagttattatac

SEQ ID NO: 65094 - DNA, 5529 bp, Homo sapiens
  misc_feature (180)..(180): n is a, c, g, or t
aagatggcggcggggaggtaggcagagcaggacgccgctgctgccgccgccaccgccgcctccgctccagtcgcctctggtccttcaaactcacacctcccgggaggagctgtcctggcgccgggtcccgcggggaaaatggtggagccagggcaagatttactgcttgctgctttgagngagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggcgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatatacgccttgttcgcctatatcagtgatgcagctgttattatccggctgcgcgtgggcgggaggcgg

SEQ ID NO: 65095 - DNA, 3527 bp, Homo sapiens
attctattcaaagtgccttattagcatcaggtcttggatcaaaacgacctagtttttcatctacaccagttatctcacctgctcctaacagtacggaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggcgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttcttttttttctttttttttttttttgcttccacaggttgcactattgaaaaatcgagattgtataaacctggtaaaaagctgcaagatgccaaaatcttgtagatgtcaaataaaaagttattatac

SEQ ID NO: 65096 - DNA, 234 bp, Homo sapiens
cttttcaaatggcgttcagattcagttaatagcaagggttaggctttttgtgtagagattattttaaattggctacctctagaattacagaccagactaggtaaccagtttatttaaagcaatactgttttcaatgaaattcttctcatttttacaggtcgtctcagatgatgccctgatgcactggttagatcagtataattcatctgcagatacttgtactcatgcttattg

SEQ ID NO: 65097 - DNA, 324 bp, Homo sapiens
agagcaaaactccatctcaacaaaaaaaaaagaaaagaaaagaaatttgagttgaccttgtaaatcttttagaaacgtgtctgtgtgcatatatagacactcatatgtatttctttcccatttttcttaggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtag

SEQ ID NO: 65098 - DNA, 8197 bp, Homo sapiens
  misc_feature (180)..(180): n is a, c, g, or t
aagatggcggcggggaggtaggcagagcaggacgccgctgctgccgccgccaccgccgcctccgctccagtcgcctctggtccttcaaactcacacctcccgggaggagctgtcctggcgccgggtcccgcggggaaaatggtggagccagggcaagatttactgcttgctgctttgagngagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggcgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttcttttttttctttttttttttttttgcttccacaggttgcactattgaaaaatcgagattgtataaacctggtaaaaagctgcaagatgccaaaatcttgtagatgtcaaataaaaagttattatactaaacaagaagtggagtcttgtttaggccctcactggtgaccttcagaagtagtctgtgacggggactcagcagaatttgtgtgttgtctcagcattccaggtagccttatagtttggcttaaaacttatccctaaaatgtaagatggcattgagggaaagggtataatgatagtacttctgaatgttttttaagttgaattgtttgtaaacttcttgcagaattgggtgagatgtgtgttaaaactgacaaacctggctgaaagcttagggcgttcatcctcttgtgtctcctttagcctgagtttggttatgtcaagcttaccgtaagttttcttaggatttatttattcttggtgcctaaaagaataaattgaaagtactttctgttctttggcacattttgcccagcggatgcaacttctatcctcagtccagttcatatatctcaggcagtgatccattttgtatcagccagtttcccttgttagggccgctagacccggctggcagccaagagcagcactctccccaccttcagcagaacttctcagctcatgtgtgtgtttttaaaagcagtaggcagcttccatcagcaatggaagtgtcccccactccagtggtggaggtgcagtcgctggacctgaggaagtggggaagcattacaaaccctcctgcagtaagaatggcagagttgggaaggatcttctctcgcaggctgttggcccaactcctcttttctgtgtatgagggcatcttagttttttatggcgttttcaaagcagcatatgaggattcttagcatgcagctaagtgacaacccccatggcctatgatgtaatgtttgctctggactagccatcttgataaataggagtgtatgtatcttaggttctttgtagaacagctatttttttttctcattaaaaaggcctctgaaagccctctcaaaatggacctcacaaaggcaaccagtgtgaatggatgggagctggggtgctgcatgcccaggctggtcatggtgtgtgcagcacccagagagttgcacccaccccttcttcaggtggacatccgacctttacactgtggtcttgcaaaaatcagcgagttagtttggccgccctgtgaagcttcagcattcaaggtcctcttctgttaaaacccaactcgtagccgggcgtggtggctcactcctataatcccagcacttcgggaggccaaggcaggtgcatcacttgaggccaggagttcgagaccagcctggtccacatggcaaaaccccatctgtaccaaaaaatacaaaaaatttgccgctgacttctgtaaaataggtccattcattgcaggatctaaatgccacacctgaattcagaggccttgtttaattaaccccatgtccactttgcctctgcaatgcctttttctttttagcaatatggctctgagcacaaagatttggttggaaatcatgttcgtgttttcagagtttacagcgtcaattgtactgaaaaccacttccagagtctaaagcagctcagatgttatctctgggggaattagtgttcccctcatttagcaacctccataccacaaggtctctgtctgtagttactgggattatccagatacactatcaatgatacaaattcataggagtattaatgcatttctttaaacacaacttgattaagaagcaaatatgttaagcagttttctttttctgctgctaaattacagttagacacttcagtatcttctctttacatgtgtatataaattagtaagaacctgcatccaaagcaatgtagtgtgtgtatgtatctatatatatttattctaactcagcacttcagaagcctttttgagttacaacaatattttagtttgcctcatctgtagaggtaaaatttctatattaccaagctccagaggaatatgatattttacaggcacaattttctggctgtagtccctggggcattcatttgctggcctccatgggatgctgttagaacaattgttagccggcaagagaagaaaggctaccaggacagcatttataattgtagaatgggagccttcttccctctcccctccactttcattttagcatgagataaaaaaatagattggaaatgattgttgcatctcacttcatggaagtaggggcagaagttccctctggatccttttcttgacaagcagtcaagaggaaggtccccatacacatgtacctgtgtgatacttggtagtttctaagaatggtgctacataagcgttgctgttaggctgggatcctattaatgaacgtttgattagttcaggcctcccaatggcaaaggcagacaccgtggagatggacatttactgactccccttctgtgtggcttcggtctccctggctaacaccacacctgtgcgtactgcgctcggcccactttgctgcagaaacgtagcaagcgtttcatgtcagggctacagctgagagcaaaaactgcaaaaaaaaaaa

SEQ ID NO: 65099 - DNA, 3646 bp, Homo sapiens
tactactactactaaattcgcggccgcgtcgacattttttatgggagtccaaaaggttagtgctggtttgtgaattctgtttgttttttgacttaacctaaatacttttcctctgcacttttcatttgaattaattcatgaactaaatgtgatgtactggatcttaagaaacattgaatttgggctgactctcttgtttgtggcggagggtaggtgagtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgatccctggttaattagaaaagaccacaagaaaaacaaagagaaaaaaaagaagaaaagtatagatccagattctattcaaagtgccttattagcatcaggtcttggatcaaaacgacctagtttttcatctacaccagttatctcacctgctcctaacagtacaccagctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataagaatattgctatcatctcagaagctgccagctcgggtatttcattacaagcagataggagagctaaaaatcaaaggcgaagagttcatatgactttagaattaccttggagcgctgatagagcaattcaacagttcggacgtactcatagatcaaaccaagttactgctcctgagtatgtctttctgatatctgaactggcaggagaacaaagatttgcatctattgttgctaaaagacttgagagtttgggggcacttacacatggcgatagaagggcaacagaatctagagatctgagcaggttcaactttgataataagtatggaagaaatgctttagaaattgtcatgaaatccattgtaaacttggattctcctatggtatcaccacctccagactatcctggagaattttttaaagatgttcgacaaggactgataggcgttggcctgataaatgtagaagatcgctcgggaattcttactctcgataaagattataacaacataggaaaattcttaaatagaattttaggcatggaggtgcatcagcagaatgcgttatttcagtattttgcggacacacttactgcagttgttcaaaatgccaaaaaaaatggaagatatgatatgggaatcttagatcttggttctggagatgaaaaagtgcggaaaagtgatgttaaaaagtttctgactccaggatattcaacctctggccacgtagaattatacacaattagtgtagagaggggaatgtcatgggaggaagctaccaagatttgggctgagctgacaggaccagacgatggcttttacttgtcattgcaaataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtcgtctcagatgatgccctgatgcactggttagatcagtataattcatctgcagatacttgtactcatgcttattggcgcggcaattgcaaaaaagcaagcttggggctagtttgtgaaataggtcttcgttgccgtacatattatgtattatgtggttcagtgctgagtgtctggacaaaagttgagggtgttctagcatctgtcagtggcacaaacgtgaagatgcagatcgtgcggctaagaacggaagatgggcaacggattgtaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttcttttttttctttttttttttttttgcttccacaggttgcactattgaaaaatcgagattgtataaacctggtaaaaagctgcaagatgccaaaatcttgtagatgtcaaataaaaagttattatac

SEQ ID NO: 65100 - DNA, 2345 bp, Homo sapiens
tgcagcccaaagcctggagagaggctgctgcgccattgacctgtggactccagagactcccgctgtgcattcctctgatctggaaggtttcctgaattacgtgacgagaaacctgggttcgagtcctaacttgtcaccaacttcctgagtgacctgggctggtcccgtcccctcttggaatctctgtcttccatctcttcagcgaaggggttgatttataagggtgttttctgctctgacactgtgatttgaattctgtgtttccacatgatattcgagaagtctggccggaaggatggaatctgaaatgacaatggttctggactgggctttgtgctcagcccagctcatctttgcctgagacctaggagtggccccaggctctcctgatgtgccaccacgcttggcatctgctcctctccctgcccccatattcccatgctctgaaggggagttctctttcatagcaaatccgagaggagccgaggagccaggtcctttgttccagacccagaagcagccatggggacctgtgacattgtgactgaagccaatatctcatctggccctgagagcaacaccacgggcatcacagccttctccatgcccagctggcagctggcactgtgggcaccagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctgcgccacctgcaggccaagaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctggattccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttgatcccaatgtggcagtgttgggaggtaggggttagtgggaggtgtttgggtattggggatggatcccttatgaatagattaatgccttccagttgaagtgaatcatcactcttgtgggaatggactagttcccaaaataacaagttgttagaaagagtgtggtgtcctcagtttccctgtcttgcttcctctctcaccatgtgatctctttgcacacaacacttcccttccactttccaccatgacaagaagcagcctgaggccttcaccagatgcagctgcccaatcttggatattccagccaccagaatcatgagccaaataaacctcttttctttataaattacctagtctcaggtattccatgaaagcaacacaaatggactgagataggtgcctattgaaccctgaagccttgtgcctggctgcagaatgaggtgtagcaccctttgagaagtagccaatcgagaagaccacatctgaaagttcagctcatgccccatccttcagtataccaatacaaagacaacatggggccagaactccagaaaggatgctgactttaagaggactcagccacccatctcagagagcacttcagaggatccagtaagggtcagaaaagac

SEQ ID NO: 65101 - DNA, 466 bp, Homo sapiens
aaaaaacaaaaaagaagaagaagccagtgcagtggcacacacctgtagccccagttactcaggatgttaaggcaggagggtcgttgaacccaggagttcagggccatagtatgtaatgatcttgcctgtgacttgccactgcactccagcctgggtggcagaaggagaccttgtctgaagaaaaaaaaaaaagagagagagagagagagaagtgttcagcaccatgctgcttcctctgattcctacagggagatgctgaatttgaccttgccccacctccttgaggcgcagaatcctcagacccgctgagtggaggtggacaaacagatctttgtcaccattatcttagactttgggacacaaaaatctttcagttccagagcctaaaatgctactaaaaatggaacaaatgataacctagactgtgggcacctcagaaaaagaacaagacttagttaaatttctc

SEQ ID NO: 65102 - DNA, 422 bp, Homo sapiens
cccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgacttttt

SEQ ID NO: 65103 - DNA, 2071 bp, Homo sapiens
  misc_feature (65)..(65): n is a, c, g, or t
gaaaggaaggaagcaagcaagcaaggaaggaactgcaggaggaaaagaacaggcagaacagcganaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacatcttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtcagtcagctcttctcaatccctttgcctaatgctatggttttgtttgtttgtttgtttgtttgttttttaaatactgaaaagtaaagagatgaattatttcag

SEQ ID NO: 65104 - DNA, 706 bp, Homo sapiens
  misc_feature (65)..(65): n is a, c, g, or t
gaaaggaaggaagcaagcaagcaaggaaggaactgcaggaggaaaagaacaggcagaacagcganaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagatcctagtgcagtgattctcagctgggagtgattttgcccctttcccttcctgggggacatgtggcaatgtctggagacacttttaagtgtcacaactcaggactggagaactactattgacatttaggtaaaagcaatggatgtgctaaccatcctgtaatgcacagaacaaacccctacaacaaataattatctgggctaaaatgtcaataatgctgaggttaagaaacctcattctattttttgtactcattaactatccccctcaaaacatctcatgtaccccataaatatatatacctactatgtaccacaaaattaaaaataaaaaagagtataaaatt

SEQ ID NO: 65105 - DNA, 3243 bp, Homo sapiens
  misc_feature (65)..(65): n is a, c, g, or t
gaaaggaaggaagcaagcaagcaaggaaggaactgcaggaggaaaagaacaggcagaacagcganaagaataaagggaaagggggggaaacaccaaatctatgattggacctgggcttctttttcgccaatgcaaaaaggaatatgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagattctgttcccagttctccaaaggagtctatgccatctttgggttttatgaacgtaggactgtcaacatgctgacctccttttgtggggccctccacgtctgcttcattacgccgagctttcccgttgatacatccaatcagtttgtccttcagctgcgccctgaactgcaggatgccctcatcagcatcattgaccattacaagtggcagaaatttgtctacatttatgatgccgaccggggcttatccgtcctgcagaaagtcctggatacagctgctgagaagaactggcaggtgacagcagtcaacatcttgacaaccacagaggagggataccggatgctctttcaggacctggagaagaaaaaggagcggctggtggtggtggactgtgaatcagaacgcctcaatgctatcttgggccagattataaagctagagaagaatggcatcggctaccactacattcttgcaaatctgggcttcatggacattgacttaaacaaattcaaggagagtggcgccaatgtgacaggtttccagctggtgaactacacagacactattccggccaagatcatgcagcagtggaagaatagtgatgctcgagaccacacacgggtggactggaagagacccaagtacacctctgcgctcacctacgatggggtgaaggtgatggctgaggctttccagagcctgcggaggcagagaattgatatatctcgccgggggaatgctggggattgtctggctaacccagctgttccctggggccaagggatcgacatccagagagctctgcagcaggtgcgatttgaaggtttaacaggaaacgtgcagtttaatgagaaaggacgccggaccaactacacgctccacgtgattgaaatgaaacatgacggcatccgaaagattggttactggaatgaagatgataagtttgtccctgcagccaccgatgcccaagctgggggcgataattcaagtgttcagaacagaacatacatcgtcacaacaatcctagaagatccttatgtgatgctcaagaagaacgccaatcagtttgagggcaatgaccgttacgagggctactgtgtagagctggcggcagagattgccaagcacgtgggctactcctaccgtctggagattgtcagtgatggaaaatacggagcccgagaccctgacacgaaggcctggaatggcatggtgggagagctggtctatggaagagcagatgtggctgtggctcccttaactatcactttggtccgggaagaagttatagatttctccaaaccatttatgagtttggggatctccatcatgattaaaaaaccacagaaatccaagccgggtgtcttctccttccttgatcctttggcttatgagatttggatgtgcattgtttttgcctacattggagtgagtgttgtcctcttcctggtcagccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcaggaggtctaaaattgctgtgtttgagaagatgtggacatacatgaagtcagcagagccatcagtttttgtgcggaccacagaggaggggatgattcgagtgaggaaatccaaaggcaaatatgcctacctcctggagtccaccatgaatgagtacattgagcagcggaaaccctgtgacaccatgaaggtgggaggtaacttggattccaaaggctatggcattgcaacacccaaggggtctgccctgagaaatccagtaaacctggcagtgttaaaactaaacgagcaggggcttttggacaaattgaaaaacaaatggtggtacgacaagggcgagtgcggcagcgggggaggtgattccaaggacaagacaagcgctctgagcctcagcaatgtggcaggcgtgttctacatcctgatcggaggacttggactagccatgctggttgccttaatcgagttctgctacaaatcccgtagtgaatccaagcggatgaagggtttttgtttgatcccacagcaatccatcaacgaagccatacggacatcgaccctcccccgcaacagcggggcaggagccagcagcggcggcagtggagagaatggtcgggtggtcagccatgacttccccaagtccatgcaatcgattccttgcatgagccacagttcagggatgcccttgggagccacgggattgtaactggagcagatggagaccccttggggagcaggctcgggctccccagccccatcccaaacccttcagtgccaaaaacaacaacaaaatgaaacgcaaccaccaccaaccactgcgaccacaagaaggatgattcaacaggttttcctgaagaattgaaaaaccattttgctgtcccttttccttttttgatgttctttcacccttttctgtttgctaagtgaggatgaaaaaataacactgtactgcaataaggggagagtaaccctgtctaatgaaacctgtgtctctgagagtagagtcactggaacactaatgaggaaactgcactgttttattttaattcagttgttagtgtgtcttagtgtgtgcaatttttccc

SEQ ID NO: 65106 - DNA, 3352 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccgggccattaaattcagctgaaaggaaacctggtgtgaagcatgcaccatatataaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctggaacaagatgggggcagtgaaggtatggtttagtgtttgctttcatagtatgccatgtacaatgttttatatttcatagtttcttttaagtaactaccatgagtctctctaagcctcatggacaaagatgtagaccaaatgcaagagctgagcttgctttgggttcaaccatgatcaaagaaaaactgaggtcacctgcaggcttacgtgggaagctaagaaaatatcacagaaaaatggaaagaaatatggatgtgcagaggtaataaaaagagctgctgctggacatttatcaaagataggcaccttacagtatcttgttgcaagtccaaatcaggggagactttgttaatatgtatcttttgctcaaatttagtagggttttttttttttttggattaagggcttttcaaatttggaatttgtagaagccaattaaaagaatacccttcctaaaaaccaaattgacacagctggcccccctgctagccaacccgcagttcccagttcccacctgctgagagttcagaactcagaccgtaggtgtgggcttatgagactgtgcttcatgaagaaaagcagaattccaaattcaaactgttggagtgagccaagtggacagaccctccatgagtgcactttcttccaagaaatccccagatttaccccatagaggtctgggattacctggaatataatatgaaaaacattttttaggctgggtgtggggctcacacctgtaatcccagcactttgggaggctgaggcgggcggatcacctgaggttgggagctcgagaccagcctgaccaatgtgaagaaaccccgtctctactaaaaaaaatacaaaattagcctggtgtggtggcgcatgcctgtaatcccggctactcaggaggcggaggcaggagaatcacttgaacccgggaggcaggttgcggtgagacgagatcacgccattgcactccagcctgggcaaaaagagctaaaaactcccctcaaaaaaaaaaagaaaaaaagaaaaacgttttttaattcaacccaaagtctgaatttcttgaggaaaaggtcaatgtcttttcatctctgtattgttccccacctcttaacacagtgcctggcacatactaggtgctcaataaatgtctgttgaatagaattattaataatttaagagtaggaaaaaggagtgtcagagagagactcaaagatgagtgagagagcatggaagatggctgtttcatgtgagacaggaatggaagaagttatgaatagggatcagatgggggagtgagaatccctgtaagtaaaatgtgaggaaaagaacaagctgagaacaagattctcctgtcaaaaaggcgtcttactgtaaatagtccaaggtgacatttgttagttttgaatactgcttttgggtttctttttttcatttttatattttaaaatttttatcaaagaacaaagacttatgtagttttcttttattctacacaatccaaattaaacagcttttggtgatgcaattgtacactttcttaagaatatatctaataccacattttagcagaaccaagcaatgactgacattattcattgggatctggccactaaataaaattcttttatgcataattgttatttctttgtctcttacaccaccatttcttctctaatattaaaacatctgaaaacccagtcagatattatgctaaaaatgaacttaagtgttatattggtagggtgttttccaacaccatcaaccaattctctgattcttccggacaccaattgagtatctacaattcaattgtgacactaactacccggagttagtgtcaggttccacaagaaaaaaaggcgagccaccaccccccccacaccccaccccacccacacaccaaaaaaaaggagacctcacttctgtccatattggctacaaagtcgaaggggctcccacacactgcccgcttaaggttcaaataatttgctagaacagctcac

SEQ ID NO: 65107 - DNA, 2835 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccgggccattaaattcagctgaaaggaaacctggtgtgaagcatgcaccatatataaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctgctgagagttcagaactcagaccgtaggtgtgggcttatgagactgtgcttcatgaagaaaagcagaattccaaattcaaactgttggagtgagccaagtggacagaccctccatgagtgcactttcttccaagaaatccccagatttaccccatagaggtctgggattacctggaatataatatgaaaaacattttttaggctgggtgtggggctcacacctgtaatcccagcactttgggaggctgaggcgggcggatcacctgaggttgggagctcgagaccagcctgaccaatgtgaagaaaccccgtctctactaaaaaaaatacaaaattagcctggtgtggtggcgcatgcctgtaatcccggctactcaggaggcggaggcaggagaatcacttgaacccgggaggcaggttgcggtgagacgagatcacgccattgcactccagcctgggcaaaaagagctaaaaactcccctcaaaaaaaaaaagaaaaaaagaaaaacgttttttaattcaacccaaagtctgaatttcttgaggaaaaggtcaatgtcttttcatctctgtattgttccccacctcttaacacagtgcctggcacatactaggtgctcaataaatgtctgttgaatagaattattaataatttaagagtaggaaaaaggagtgtcagagagagactcaaagatgagtgagagagcatggaagatggctgtttcatgtgagacaggaatggaagaagttatgaatagggatcagatgggggagtgagaatccctgtaagtaaaatgtgaggaaaagaacaagctgagaacaagattctcctgtcaaaaaggcgtcttactgtaaatagtccaaggtgacatttgttagttttgaatactgcttttgggtttctttttttcatttttatattttaaaatttttatcaaagaacaaagacttatgtagttttcttttattctacacaatccaaattaaacagcttttggtgatgcaattgtacactttcttaagaatatatctaataccacattttagcagaaccaagcaatgactgacattattcattgggatctggccactaaataaaattcttttatgcataattgttatttctttgtctcttacaccaccatttcttctctaatattaaaacatctgaaaacccagtcagatattatgctaaaaatgaacttaagtgttatattggtagggtgttttccaacaccatcaaccaattctctgattcttccggacaccaattgagtatctacaattcaattgtgacactaactacccggagttagtgtcaggttccacaagaaaaaaaggcgagccaccaccccccccacaccccaccccacccacacaccaaaaaaaaggagacctcacttctgtccatattggctacaaagtcgaaggggctcccacacactgcccgcttaaggttcaaataatttgctagaacagctcac

SEQ ID NO: 65108 - DNA, 1647 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccgggccattaaattcagctgaaaggaaacctggtgtgaagcatgcaccatatataaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctggaacaagatgggggcagtgaaggtatggtttagtgtttgctttcatagtatgccatgtacaatgttttatatttcatagtttcttttaagtaactaccatgagtctctctaagcctcatggacaaagatgtagaccaaatgcaagagctgagcttgctttgggttcaaccatgatcaaagaaaaactgaggtcacctgcaggcttacgtgggaagctaagaaaatatcacagaaaaatggaaagaaatatggatgtgcagaggtaataaaaagagctgctgctggacatttatca

SEQ ID NO: 65109 - DNA, 506 bp, Homo sapiens
tctcatttagggaagctgggttacctggcacttcctggagtccagcagagagcaaggaaagggactcaccatttcagcagcaggaggcacaaaacctcccagcggctgtcagggccgtgaaagcttaagaccccgcaggtgtgagccaagtccaaccatccaggaacattcgggactggaagctaattcagagagccgggtagaccccgtgcgtggagaacgcaggacccgctgggactggttgggctgcgctggccccggctgaggctcctgcactgaccacgccctgtctctccccggcccacgccccggctggaccaccaggtcttcctgaagagcgacagcctgtgtctgatggaagggcggcgcttccgggcgcagcccaccctgccctcggcccacctcctggccatgcacatccagcagctggagacaggcggcttcaccatgaccaacggggcccacaggtggagcaagctcaggtgaggaggggctcaggcggccgc

SEQ ID NO: 65110 - DNA, 902 bp, Homo sapiens
ggatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgagccgtcagcagccaccatgaatcctgcgagccgccacagtagtcctcaccttggttcgtgagcagggctcccgctctcaggagagccgccctcatcgacgctgggcagccgcagcagacagtccctgtggacagagaggtgggaggctcgactccttctcttcatccacctgttttcaaagcagtgagtgcatccagcgtcctccaacgtggaccagtgagcttggttttatgatcttatgaatttaagattcgcacgtctttgatgggattttgtctgttctgctgattccacctgaagctcagaaggcaccccggtccttgggacgcagctctgctgggctctgacccacttcctggtgtggcaggatgctccagccccttctatggggttcctgccccgaaatctgatcaaccatttgtctgcagagccctggccagtgaggccctgtctgggcccaggcggtcctgggagcccccaggtgcgtgttcacagtgtcctcctgaggcccgggctgtggtggacccaccacgctgagtgc

SEQ ID NO: 65111 - DNA, 475 bp, Homo sapiens
ggatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgagagccctggccagtgaggccctgtctgggcccaggcggtcctgggagcccccaggtgcgtgttcacagtgtcctcctgaggcccgggctgtggtggacccaccacgctgagtgc

SEQ ID NO: 65112 - DNA, 394 bp, Homo sapiens
gtttcgacctctggtcgagttccgcacctcgtgagctgagttccccccccgagtacgacgtgaccgggaacacctttgagcctccaccccatgaggctcccctctccaccccgctgccctgagcaccaatgggctccagtggcccggcctggaagactccgacccctcccccatcgctggcctgtttgcttggcattcatccacgacatgcaggcttagcaagcgtctgggctcacagacagcagggtgagtggggtcctgcctcttgctggttctggtctacacaagtgacagacttgatgtgagacccacaggctggggatccaataatgctgggacatgagaatggggccccaaggctcttgtttgcatcagaggcctccagaggccactg

SEQ ID NO: 65113 - DNA, 4515 bp, Homo sapiens
  misc_feature (2245)..(2245): n is a, c, g, or t
gttccgtggctctgacgtccagggaacagcaggacgactcttgaaacaaaatgagacgtggtctaaagccctttccctgacccacgcgttgaaacgctgccacgagtcgtccgtttccccagggaatcgtctcggtgggggtgccggggcctggctgggggtcctgccgggctcacggccagggccggtcttggcaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagaccagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctcccnggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggacgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggcaagtgggctccgggccccgctctgccccgtgaggcagtagcttcagacgggcctcccactgttggatgctgtaaatctgtccgtgtgaagttataaaaggggccctgatttgagggtccaatgccaggaagccctggggcgaggggcagagtgaccaagcgcccgtgtcccgctccggcaggtcatgtacgcggaacgctggggcctggagccctgcaccctcccagtgatcgtgaacatcgcggccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccagtgatgccttcctggagggttatgtgcagcaattcctctacaccttccgctacttctgcacaccccacgacttcctgcacttcctcctcgaccgcatcaacagcacgctgaccagggcccaccaggaccccacctcgaccttcaccaagatctacaggcggagcctctgcgtcctgcaggcctgggtggaggactgctacgctgtggacttccctcggaacagcgggctgctggggaagctagaggacttcatctcctccaagatcctacccctggacggctctgccaagcacctgctgggcctcctggaggtgggcatggaccggcgggccgagggcaaccctcgcggcacagacctggagaaccccagggaggccgaggaggatgccagacccttcaacgccctctgtaagaggctctcagaggacggcatctccaggaagg

SEQ ID NO: 65114 - DNA, 868 bp, Homo sapiens
aacaggtcttaggtggtccctgctctcagacctaccccatggctcacccaggcacgccctgctagggatggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgagccgtcagcagccaccatgaatcctgcgagccgccacagtagtcctcaccttggttcgtgagcagggctcccgctctcaggagagccgccctcatcgacgctgggcagccgcagcagacagtccctgtggacagagaggtgggaggctcgactccttctcttcatccacctgttttcaaagcagtgagtgcatccagcgtcctccaacgtggaccagtgagcttggttttatgatcttatgaatttaagattcgcacgtctttgatgggattttgtctgttctgctgattccacctgaagctcagaaggcaccccggtccttgggacgcagctctgctgggctctgacccacttcctggtgtggcaggatgctccagccccttctatggggttcctgccccgaaatctgatcaaccatttgtctgcagagccctggccagtgaggccctgtctgggcccaggcggtcctgggagcccccaggtgcgtgttcacagtgtcctcctgaggcccgggctgtggtggacccaccacgctgagtgc

SEQ ID NO: 65115 - DNA, 1528 bp, Homo sapiens
tctcatttagggaagctgggttacctggcacttcctggagtccagcagagagcaaggaaagggactcaccatttcagcagcaggaggcacaaaacctcccagcggctgtcagggccgtgaaagcttaagaccccgcaggtgtgagccaagtccaaccatccaggaacattcgggactggaagctaattcagagagccgggtagaccccgtgcgtggagaacgcaggacccgctgggactggttgggctgcgctggccccggctgaggctcctgcactgaccacgccctgtctctccccggcccacgccccggctggaccaccaggtcttcctgaagagcgacagcctgtgtctgatggaagggcggcgcttccgggcgcagcccaccctgccctcggcccacctcctggccatgcacatccagcagctggagacaggcggcttcaccatgaccaacggggcccacaggtggagcaagctcaggaacatcgcaaaggtggtgagccaggtgcacgcgttccaggagaacccttacaccttcagccccgaccccaagctccagtcgtacctcaagcagaggattgcccgcttcagcggtgccgacatttccacactcgccgcagatagcagggccaacttccaccaggtctccagcgagaagcactcacggaagattcaggacaagctacggaggatgaaggctacattccagtagccgagctcgggcctggtgtggaattccagatccgaatccgactgtggggggcgggctgggaggtgggagccgcgtctcaggcccggccgttatcaaggcccctccgcccccgaaccctggggagctggaccaggaggtggaggctcaggggaccccatggggacaggcagagctggtctcctcccagcagacggagccaggacgggcacaagagtcttggaggtttgcgtgtttctgctagaattaaaaagttaaatttaaaaatgaaaatgaaagacagcttcccaggagttttgtgcctgtctgcgcctctcacacacagataagtggctcttacccagctctcagtgactcccccacaaaacagcaacagcctccaccgccaactcaacaaacttcagagtagctcctccctgagcaggtttctgagccagcctcggttggctgagcaacgaagggccaaagctgacctctgagtggccaactgcagctcccagggactccgagacctccggtccgagaccctgcctgggttcaccccccacaacccagacccagaaccgctctccccttccctgcccagtgcccctcttccccagcccagacccccaggtgcccaaggcctgctgctggagcaggcaccttgggctgggcctgctcccccagggcccagggccccccagcttagaacagccttggtgaggtggtcatgcccgggcaaaggccctgcttcctggaaaggacactcagagcagctccaagacagaggctctgtggcgggggtccctgagagtgcccccacccatctcatgcc

SEQ ID NO: 65116 - DNA, 676 bp, Homo sapiens
ggatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgagcctccaccccatgaggctcccctctccaccccgctgccctgagcaccaatgggctccagtggcccggcctggaagactccgacccctcccccatcgctggcctgtttgcttggcattcatccacgacatgcaggcttagcaagcgtctgggctcacagacagcagggtgagtggggtcctgcctcttgctggttctggtctacacaagtgacagacttgatgtgagacccacaggctggggatccaataatgctgggacatgagaatggggccccaaggctcttgtttgcatcagaggcctccagaggccactg

SEQ ID NO: 65117 - DNA, 5223 bp, Homo sapiens
  misc_feature (2245)..(2245): n is a, c, g, or t
gttccgtggctctgacgtccagggaacagcaggacgactcttgaaacaaaatgagacgtggtctaaagccctttccctgacccacgcgttgaaacgctgccacgagtcgtccgtttccccagggaatcgtctcggtgggggtgccggggcctggctgggggtcctgccgggctcacggccagggccggtcttggcaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagaccagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctcccnggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggacgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggcaagtgggctccgggccccgctctgccccgtgaggcagtagcttcagacgggcctcccactgttggatgctgtaaatctgtccgtgtgaagttataaaaggggccctgatttgagggtccaatgccaggaagccctggggcgaggggcagagtgaccaagcgcccgtgtcccgctccggcaggtcatgtacgcggaacgctggggcctggagccctgcaccctcccagtgatcgtgaacatcgcggccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccagtgatgccttcctggagggttatgtgcagcaattcctctacaccttccgctacttctgcacaccccacgacttcctgcacttcctcctcgaccgcatcaacagcacgctgaccagggcccaccaggaccccacctcgaccttcaccaagaacccttacaccttcagccccgaccccaagctccagtcgtacctcaagcagaggattgcccgcttcagcggtgccgacatttccacactcgccgcagatagcagggccaacttccaccaggtctccagcgagaagcactcacggaagattcaggacaagctacggaggatgaaggctacattccagtagccgagctcgggcctggtgtggaattccagatccgaatccgactgtggggggcgggctgggaggtgggagccgcgtctcaggcccggccgttatcaaggcccctccgcccccgaaccctggggagctggaccaggaggtggaggctcaggggaccccatggggacaggcagagctggtctcctcccagcagacggagccaggacgggcacaagagtcttggaggtttgcgtgtttctgctagaattaaaaagttaaatttaaaaatgaaaatgaaagacagcttcccaggagttttgtgcctgtctgcgcctctcacacacagataagtggctcttacccagctctcagtgactcccccacaaaacagcaacagcctccaccgccaactcaacaaacttcagagtagctcctccctgagcaggtttctgagccagcctcggttggctgagcaacgaagggccaaagctgacctctgagtggccaactgcagctcccagggactccgagacctccggtccgagaccctgcctgggttcaccccccacaacccagacccagaaccgctctccccttccctgcccagtgcccctcttccccagcccagacccccaggtgcccaaggcctgctgctggagcaggcaccttgggctgggcctgctcccccagggcccagggccccccagcttagaacagccttggtgaggtggtcatgcccgggcaaaggccctgcttcctggaaaggacactcagagcagctccaagacagaggctctgtggcgggggtccctgagagtgcccccacccatctcatgcc

SEQ ID NO: 65118 - DNA, 4947 bp, Homo sapiens
  misc_feature (2152)..(2152): n is a, c, g, or t
ggatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagaccagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctcccnggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggacgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggtcatgtacgcggaacgctggggcctggagccctgcaccctcccagtgatcgtgaacatcgcggccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccagtgatgccttcctggagggttatgtgcagcaattcctctacaccttccgctacttctgcacaccccacgacttcctgcacttcctcctcgaccgcatcaacagcacgctgaccagggcccaccaggaccccacctcgaccttcaccaagaacccttacaccttcagccccgaccccaagctccagtcgtacctcaagcagaggattgcccgcttcagcggtgccgacatttccacactcgccgcagatagcagggccaacttccaccaggtctccagcgagaagcactcacggaagattcaggacaagctacggaggatgaaggctacattccagtagccgagctcgggcctggtgtggaattccagatccgaatccgactgtggggggcgggctgggaggtgggagccgcgtctcaggcccggccgttatcaaggcccctccgcccccgaaccctggggagctggaccaggaggtggaggctcaggggaccccatggggacaggcagagctggtctcctcccagcagacggagccaggacgggcacaagagtcttggaggtttgcgtgtttctgctagaattaaaaagttaaatttaaaaatgaaaatgaaagacagcttcccaggagttttgtgcctgtctgcgcctctcacacacagataagtggctcttacccagctctcagtgactcccccacaaaacagcaacagcctccaccgccaactcaacaaacttcagagtagctcctccctgagcaggtttctgagccagcctcggttggctgagcaacgaagggccaaagctgacctctgagtggccaactgcagctcccagggactccgagacctccggtccgagaccctgcctgggttcaccccccacaacccagacccagaaccgctctccccttccctgcccagtgcccctcttccccagcccagacccccaggtgcccaaggcctgctgctggagcaggcaccttgggctgggcctgctcccccagggcccagggccccccagcttagaacagccttggtgaggtggtcatgcccgggcaaaggccctgcttcctggaaaggacactcagagcagctccaagacagaggctctgtggcgggggtccctgagagtgcccccacccatctcatgcc

SEQ ID NO: 65119 - DNA, 4573 bp, Homo sapiens
  misc_feature (1830)..(1830): n is a, c, g, or t
  misc_feature (1888)..(1889): n is a, c, g, or t
  misc_feature (1956)..(1957): n is a, c, g, or t
  misc_feature (2333)..(2333): n is a, c, g, or t
  misc_feature (2404)..(2405): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaagctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65120 - DNA, 4522 bp, Homo sapiens
  misc_feature (1779)..(1779): n is a, c, g, or t
  misc_feature (1837)..(1838): n is a, c, g, or t
  misc_feature (1905)..(1906): n is a, c, g, or t
  misc_feature (2282)..(2282): n is a, c, g, or t
  misc_feature (2353)..(2354): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacgatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaagctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65121 - DNA, 4583 bp, Homo sapiens
  misc_feature (1840)..(1840): n is a, c, g, or t
  misc_feature (1898)..(1899): n is a, c, g, or t
  misc_feature (1966)..(1967): n is a, c, g, or t
  misc_feature (2343)..(2343): n is a, c, g, or t
  misc_feature (2414)..(2415): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaaagctgtggaggctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65122 - DNA, 5403 bp, Homo sapiens
  misc_feature (1657)..(1657): n is a, c, g, or t
  misc_feature (2332)..(2332): n is a, c, g, or t
  misc_feature (2417)..(2417): n is a, c, g, or t
  misc_feature (2660)..(2660): n is a, c, g, or t
  misc_feature (2718)..(2719): n is a, c, g, or t
  misc_feature (2786)..(2787): n is a, c, g, or t
  misc_feature (3163)..(3163): n is a, c, g, or t
  misc_feature (3234)..(3235): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaaagctgtggaggctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactgggtgagggccagaggggctgggcggggcntgggcggggccctccctccttcacatggccgccgttcctctgttaaggcactcactctggcctgccctcttgctcgagtgaaaccaacccagacacctctgtgccaggcacggagttgagcgttggagactcagcagtatcagacagagaagccgctgtcctttctggggagttgggggcccactcagtggctttggcttggcgtctgtctctccctcctccttgcctgatcccccctgcccgaccccccagggctctgcatctctggctgactgctcaggtgtgtgtgtctgagtgtgtgtaagagtttgtgtgtctctacttctgtctctgtctctctgaaaatccactgacagctctccacctccctctgctgctctcttttgtctgcttacttttcgctttctctggctgccggctgatttcagcctggctgtgtatctgtctctggctgtccctcccgtgtctttgaccctgtctgtgtttcattcaggctcagcttctgcttctccctggctatctctgtgtgtgtccctgcccctctgcccgcatttctggctgtctctgccagtctgtctccatccctatttgcctatttgcctgaagagacaggcagtttctctgtctcttcatatccatctgtgtctctctgcctctgtgactttttctctggcntttcttgctgtccccctgtctctctgcatctctgtctgtctccctgcccactgccatccaccctccttcagagccttgccctcanctcctcctttccctgccctcctgtgcccacagggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65123 - DNA, 4371 bp, Homo sapiens
  misc_feature (1840)..(1840): n is a, c, g, or t
  misc_feature (1898)..(1899): n is a, c, g, or t
  misc_feature (1966)..(1967): n is a, c, g, or t
  misc_feature (2343)..(2343): n is a, c, g, or t
  misc_feature (2414)..(2415): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaaagctgtggaggctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65124 - DNA, 4529 bp, Homo sapiens
  misc_feature (1840)..(1840): n is a, c, g, or t
  misc_feature (1898)..(1899): n is a, c, g, or t
  misc_feature (1966)..(1967): n is a, c, g, or t
  misc_feature (2343)..(2343): n is a, c, g, or t
  misc_feature (2414)..(2415): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaaagctgtggaggctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccacaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65125 - DNA, 706 bp, Homo sapiens
gcgacgcgatcgcttagggacacagtggacgaggggagagtccatctgctggcattttgtggggtgttagtgccaaacttgaataggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65126 - DNA, 4556 bp, Homo sapiens
  misc_feature (1840)..(1840): n is a, c, g, or t
  misc_feature (1898)..(1899): n is a, c, g, or t
  misc_feature (1966)..(1967): n is a, c, g, or t
  misc_feature (2343)..(2343): n is a, c, g, or t
  misc_feature (2414)..(2415): n is a, c, g, or t
  misc_feature (4508)..(4508): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaaagctgtggaggctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggtccctgccttacccaatgtcttcgtttgccccgctaggttccccacagagaccaatgacattttgccacttgataccataaataaagttttttgggaattggtgnaaaaataaggggggtaatgataagtattctttcgtgggggggctggga

SEQ ID NO: 65127 - DNA, 4447 bp, Homo sapiens
  misc_feature (1840)..(1840): n is a, c, g, or t
  misc_feature (1898)..(1899): n is a, c, g, or t
  misc_feature (1966)..(1967): n is a, c, g, or t
  misc_feature (2343)..(2343): n is a, c, g, or t
  misc_feature (2414)..(2415): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaaagctgtggaggctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctactcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65128 - DNA, 3629 bp, Homo sapiens
  misc_feature (1840)..(1840): n is a, c, g, or t
  misc_feature (1898)..(1899): n is a, c, g, or t
  misc_feature (1966)..(1967): n is a, c, g, or t
  misc_feature (2343)..(2343): n is a, c, g, or t
  misc_feature (2414)..(2415): n is a, c, g, or t
atgtgtctggtggggctggcggaggctcaacgcggggaagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagtgctgaaagctgtggaggctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggtgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctnttcaccaccaccacgcgcctgcctccctacgccacgcgctggccgcctcgtccccccnntggcgccccgggcacacgccgcccccgccgcctgccaccctgcctcccgagcccgagcccgagcccnncccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttngccccggggccctgaccctgctgcccagtggcctggggccaccgccacccccaccgcccccctcccttcanncttcgggcccttccccccgccccctcccaccgctaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgtttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgttttacttcctatcccttattacgatcttttttacattttttttgattactttaaatgtcgtttgtatctgcttaatcacatttggattatttattttatatccatttggttttctcttacttccttttatttttatcttctttttacttccattcttcgac

SEQ ID NO: 65129 - DNA, 332 bp, Homo sapiens
gccaagcgttcatagcgacgtcggcttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgttaaaaaaaaaaaagcaaacaca

SEQ ID NO: 65130 - DNA, 2025 bp, Homo sapiens
agaacgagattccgagactggattgcgatgcgccagcctggcacactctccgagatttaactgaaggcagcgccgtcaaccgctttcccctcgcccctaaccccctcaggccggcccagagccataaagctctgttctctttacccaagatgctcgcccaatccaacggtccgaggccagcgctctgatctccacagaagatttttttccttgcagggagctggccgtttaaacagaaaaacaggggtttaaaaaaaaaaaaaaaaaaaaggaaatatacccacccccaaacgtgcctccccagcgccgcagggaggcaacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacattttttgcccccataactcgtggactacaaagcacaaaggacctgaaaaatgtacagcttcaatactcttcgactctacctttcgggagccattgtattcttcagccttgctgcttctaaggaggctgaagctgctcgctccgcaaccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaatagcacaggaatctgagagacggt

SEQ ID NO: 65131 - DNA, 1051 bp, Homo sapiens
tgtttttcttgaagtagatctttttttctttttaaaggctgataatggaggccccaaagtagccatctgttactttgttccattactctaattgcttgcctcttaggatctggctaggactaacagttttcaaaattgagtaacacacttgacaaaaaaaaaggaaccaaactcaaactcaactgttatctagaaaaaagactgtgtaaatatgtgtgagaggcaagtatactctgtttgccctcttgtaagagggataggggaggccactcagctgctagcactctgttctctcccctcatcctctccagaatgtattttagaacttgactcttctaatgactgaagaaaaggtggggtatgggaagatggcctgggactgcagggtcacttacactcacctggctaagagttgagatctggctggtgccctggagtggcacctgccactcacctaatcctaaacaatccagggtgtgggcccaggattgccctctgccttttgaaacaccctccctggttccggcttctaagaccaacagggaggctactttggtggcagggagctgactcaccctccagttggaactggtgctaaaagcctccatttaacgacagccgactgcttggccccaagtgggctgccttgtgggggggaaagttcagtggaaagtgttggaggaagcagggtggtgtgtgaatatccaagtagtgctggtgctattaagctctgacacagtcagggaggtcagttaaaatgtggtcttatggccgggcgcagtggctcgcgcctgtaatcccagcactttgggaggctgaggtgggcagatcacctgaggtcaggagttcgagaccagcctggccaacatggtgaaaccccgtctctaccaataatacaaaaattaactgggcatggtggcaggtgcctgtaatcccagctacttgggaggctgaggcaggagaatcgcttgaacctgagaggtggaggttgcagtgagccaagatcgcgctactgcactccagcctgagtgacagaacaagactccatctc

SEQ ID NO: 65132 - DNA, 668 bp, Homo sapiens
ctgtggattgttattagtctcactatagggcagattgtccaagtgagctcgactttcggccgcatatatggtaaagggagactctattgtctgtgatggagtcatgttctgtcactcaggctggagtgcagtagcacgatcttggctctctgcaacctgcacctgtcaggttcaagcgattctctgactcaccctccagttggaactggtgctaaaagcctccatttaacgacagccgactgcttggccccaagtgggctgccttgtgggggggaaagttcagtggaaagtgttggaggaagcagggtggtgtgtgaatatccaagtagtgctggtgctattaagctctgacacagtcagggaggtcagttaaaatgtggtcttatggccgggcgcagtggctcgcgcctgtaatcccagcactttgggaggctgaggtgggcagatcacctgaggtcaggagttcgagaccagcctggccaacatggtgaaaccccgtctctaccaataatacaaaaattaactgggcatggtggcaggtgcctgtaatcccagctacttgggaggctgaggcaggagaatcgcttgaacctgagaggtggaggttgcagtgagccaagatcgcgctactgcactccagcctgagtgacagaacaagactccatctc

SEQ ID NO: 65133 - DNA, 451 bp, Homo sapiens
ttagagggtaaactaagtttttttatcaacctcactccttttatccctttatcctggttttttcatttgtcgtttgcattgctcatctccgtatcgcctcacctctgtctcaaaaaaaaaaaaaaaaattatgggaggggtataaaagttgaggtgtaatgagtattcatcaagaattaataggaagcaaatttgaaatttgctcacagagaaatcacaccagtatatcaaaaacagctaatactacacaaaaaacataaatgccataaaaacacttttatttattattttataaggttacatttgttttctgggcatactcagttgaggtaaatggtaggattcatttgtatcacctggacacagctcagctgtatggcacctcggcgtgtgcagcaactacttcgtccagtgggacttctccacacggcagaagagggagaggagatga

SEQ ID NO: 65134 - DNA, 1239 bp, Homo sapiens
ctcaaactgcaccccaactctaattgacttcagaaggtgatttcctcagcctgccttatcttttctttaaaaccttagctgtatacaggaaagaaagtattatacttctgaaggataaatagtatacctagaaccattcttattttgaaaattgggaagcatccgtgtgttgcctttggagtgacagtattaaagggtttgcaaattgctgttttccttgggaggattactcaaaattaaaaagcagaaaagctgagtttggaagattgccctttcttgattccattccagctttgctaggttttttttagcacgctgtcaacacttacttgactgtccttgctcactggaattcccaaatattccctataaaaatatcagaccaccagcaagaagggtggggagtgagaaaggaaggttgctatctcacctggggagatagccgcctgtcattttcaacaaaacacctgaccttcatcatggatcctcttatgtgcaaacagataaattagcttgtgaaattatattactaagaggacaactgcacttaaaaaggatcatagaagctctttaaatagaatagtgtttgtttgtcaataataaaatatttatgggaggccgggcacagtggctcacgcctgtaatcccagcactttgggaggccgaggcaggaggatcgcttgagtccaggagtttgagaccagcctggggcaacatggcaaaaccctacccctaccaaaaatatgaaaattagccgggcatggtggcatgcagctgtagtcccagctacttgggtggctgaggcaggagaatcgcttgaacctgagaggcagaggttgcagtgagccaagatagtgccactgcacttcagcctgggcgacagagcaagactctgtctcaaaaaaaaaaaaaaaaattatgggaggggtataaaagttgaggtgtaatgagtattcatcaagaattaataggaagcaaatttgaaatttgctcacagagaaatcacaccagtatatcaaaaacagctaatactacacaaaaaacataaatgccataaaaacacttttatttattattttataaggttacatttgttttctgggcatactcagttgaggtaaatggtaggattcatttgtatcacctggacacagctcagctgtatggcacctcggcgtgtgcagcaactacttcgtccagtgggacttctccacacggcagaagagggagaggagatga

SEQ ID NO: 65135 - DNA, 2946 bp, Homo sapiens
  misc_feature (346)..(346): n is a, c, g, or t
tgcccgcagcctctcctccccttcctccccgccgccacggccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcaggtgncggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65136 - DNA, 2782 bp, Homo sapiens
  misc_feature (346)..(346): n is a, c, g, or t
tgcccgcagcctctcctccccttcctccccgccgccacggccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcaggtgncggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcaccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65137 - DNA, 2946 bp, Homo sapiens; identical to SEQ ID NO: 65135
  misc_feature (346)..(346): n is a, c, g, or t

SEQ ID NO: 65138 - DNA, 3355 bp, Homo sapiens
  misc_feature (346)..(346): n is a, c, g, or t
tgcccgcagcctctcctccccttcctccccgccgccacggccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcaggtgncggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggtagcctccccccaacccacccattttgggtaggtgggtagctaagacacagggaaagaggggatcctgcccaagtgaactgtgtgggaagggtttgtggagggattggaaggggtggggagaagccagtatctcccctggggacggggataccatgcccccagggacctttcccccttcaccaactttaatcttgtatttccttttccaaaaagccaagcagaagcaaaagcaggtgagtcaaggaagggacctgggctggggggatcatggcttatggctctggggacagtgttctaggcagtcattgttggagggcagaacagagaggggagggagcccagaacctctggatctgccctgacgccaaccaggcatgagacaggcaccagggccatggtttctactgacctcatgtccattctgcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65139 - DNA, 2994 bp, Homo sapiens
ggcgggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggtagcctccccccaacccacccattttgggtaggtgggtagctaagacacagggaaagaggggatcctgcccaagtgaactgtgtgggaagggtttgtggagggattggaaggggtggggagaagccagtatctcccctggggacggggataccatgcccccagggacctttcccccttcaccaactttaatcttgtatttccttttccaaaaagccaagcagaagcaaaagcaggtgagtcaaggaagggacctgggctggggggatcatggcttatggctctggggacagtgttctaggcagtcattgttggagggcagaacagagaggggagggagcccagaacctctggatctgccctgacgccaaccaggcatgagacaggcaccagggccatggtttctactgacctcatgtccattctgcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65140 - DNA, 1814 bp, Homo sapiens
  misc_feature (346)..(346): n is a, c, g, or t
tgcccgcagcctctcctccccttcctccccgccgccacggccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcaggtgncggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaactcttaagtcttttgtaattctggctttctctaataaaa

SEQ ID NO: 65141 - DNA, 854 bp, Homo sapiens
tctagaggatccctcggcactgcttcggatgcaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65142 - DNA, 467 bp, Homo sapiens
gggttacatgggtgtatgcatttgtcagaacttatcaaactgtatacttacaatctgtgcatttcactgtttgcgaattacgtatcaagatattttttaagttaaacacaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65143 - DNA, 659 bp, Homo sapiens
ggcgggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65144 - DNA, 432 bp, Homo sapiens
cacgtcgcaccgccggttcaaacaggagcagaaggcagagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgggaagtgcagagtgagatcgagcgcatatttgaactgcggtgcgcgtgggggatcctcta

SEQ ID NO: 65145 - DNA, 3295 bp, Homo sapiens
  misc_feature (346)..(346): n is a, c, g, or t
tgcccgcagcctctcctccccttcctccccgccgccacggccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcaggtgncggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtcaaaaatacgcaaaaaaaaaaaagggggcgacaaaatacctcggagggggccaaataacgctacccgcgttctgttccacgggggcccaaaaggagggggcgatatagacgagggcagggagcgcgcttacaacgggcgcgaggacaacggcactggggcactgggaggaaaccaactgcgcggggggaatcgggaacacaccagcagaaagccgacgcaacaaaggggcgaggcaaacaccaagacgaaggtcgatacgatacagaagagagcagcgacagacaagaagaacaaacaggcacagaacagggacacagtgaaaacagtcgccgcgccacgcatcgtgcag

SEQ ID NO: 65146 - DNA, 2926 bp, Homo sapiens
  misc_feature (346)..(346): n is a, c, g, or t
tgcccgcagcctctcctccccttcctccccgccgccacggccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcaggtgncggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65147 - DNA, 2571 bp, Homo sapiens
atctcccaggagaagagcaccttgagggtcttactctttgacacctctccaggcccctgaaagaaggaattgaagagaaaggatgaaagagggggatacaaggaatactgcgtaactggggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65148 - DNA, 3048 bp, Homo sapiens
  misc_feature (346)..(346): n is a, c, g, or t
tgcccgcagcctctcctccccttcctccccgccgccacggccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcaggtgncggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattggcttcgatgaatgcccttttcctccaattccttcctgtccaccattcgggagccctcaaagcctgctggagtgagcagtgggcagagctcctggtgagcactgctgctgcctccctccatagcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 65149 - DNA, 234 bp, Homo sapiens
tccccttccccagtgctgtgtggacgatggactgaagaggagaaggctgggagcaagggaccagtaagctgttgcagcagtgcaggtgagatatgaggcctcaactctgcagtgttgacaaccatagagagcagagagcagaattcatcaatatttatcagcaccaatttttttttttaagacagagtctcacttcttcacccaggctggagtacaatggcgcaatcccagctc

SEQ ID NO: 65150 - DNA, 301 bp, Homo sapiens
gtgtcacatatttttaaatgaccagctctttggtggtagagtgtcacatagttttaaatgaccagctctttggtggcagagtgtcacatatttttaaatgaccagatctttggtggcagagtgtcacatatttttaaatgaccagatctttggtggcagagtgtcacatatttttaaatgaccagctctttggtggcggagtgtcacgtatttttaaatgaccagatctttggtggtagagtgtcacatatttttaaatgaccaggtcttgtgtgaactcagagtaagagcctactcatca

SEQ ID NO: 65151 - DNA, 473 bp, Homo sapiens
tgcctttatagtggaagaaatttttatattgtgagccacataagagaattaaggaagtactggaagaagaacgtcatattaagagagatgaatgccacattaaaaatccagctgcagtggccgtggaagggatttggagcattaaaaggaatctgcctgtgggaggcttgaagccaggactgccgagcagaaacagtttattgccacaagccaagtactactccaggcacggaggactcagaagataagatgaattagattttccattaagaaggaacctctttctgctgatgtctgaagaacggagaagaaactcaagcttgtttcaggatttaagatgtgtgcaaaaaaatgatagcctgtaattactattattggtattaatacctatctataaattaatccaaagtaatgaaagactattggtaatgttcagtaagtacctgaaaacaataaaggaaaatatacttatt

SEQ ID NO: 65152 - DNA, 622 bp, Homo sapiens
aaactccactcccagaatactgggtccaaatacagaatactaggtccaaaaggcctccatgcggctggccttcctgctgggaaggagtctgtctgtgtgtctgtctgtgtttaggaagggaggttgaggcagggcagggtcagagagcactgccgtggggaggagggtatccatttcctggtgatatccttccattcaaagcgggtatcccagaacaggtggccagggacgggtgagctggggagggccaggagagagatctctgcttgtgtgagaaaggatgccgagctggcctagaaccgctgctagactatctccaaagtttctgcagcaccctgaaggtgaaccagtgccttcagaccttccctgacacctaagccttggtcctaggaaagaaaaaaaaaaatccaaagctaacaaaatacttgagcgaatggaactgtcagcgtcaccctgtcagatccctcctgtgcgcctgcagcggaatccccacgaagtccaggtatttgagtggtggctcttttctttatctaaactctttaatgatggagagcttcccacatagaaagaactcctgtgtacccaccactagtgccagcaatcgccagatcacggccaatct

SEQ ID NO: 65153 - DNA, 416 bp, Homo sapiens
accatgtccggcctggaatccttttaaatctcccccaggtgattgtgaagaaccagggcctctctgcctctgtcactgcatttcaatatttctttaccttgatccccaatatagatgagaggggacatttgttttatcacccctaagttactacacccccttagtagctgaagcatatgaattgttgacctaagtttttcaagaagacaaaatttctctgtctggaccaattcttgaaagcctcccccttttttcagacaagcttatggcatgcagcaccccaaataaaataatctgaactaatacaggactacacattttcaacccagggcagctctggattgggtacctgaatttggcttgggctagtgatttctgactgagaaaagtattcatccagcctctgaggaaatata

SEQ ID NO: 65154 - DNA, 277 bp, Homo sapiens
caggggctgcttttcaaattacttactgtcaaaggaattgccttgttccagatccctgaggttctgcactgtgattcacctgttagggttgcttaagacttcacacagcatctttatcttccagggacactagcagcattggatctgctgagacacaaggccggacagcaagacagtttgcatcccagcagggacttgctgcagagcactgtcttgctagggatccactcaaattggtagctttccataccacccaataaatgtgttgaagctgtat

SEQ ID NO: 65155 - DNA, 1270 bp, Homo sapiens
ggggccccgcgccggcccgcgccctgcccagtgcggcctccttccacccgccgctgcctggcccgcgccgtccggccgagctgcccggcgggctggtccccgcgcccgagccgcccggccgggaccccgaacaaggccgagatgacttccaaggaggacggcaaggcggcgccgggggaggagcggcgccgcagcccgctggaccacctgcctccgcctgccaactccaacaagccagacgccgttcagcatcgaggacatcctcaacaagccgtctgtgcggagaagttactcgctgcgtggggcggcgcacctgctggccgccgcggacaagcacgcgcagggcggcttgccctggcgggccgcgcgctgctctcgaagacctcgccgctgtgcgcgctggaggagctcgccagcaagacgtttaaggggctggaggtcagcgttctgcaggcagccgaaggccgcgacggtatgaccatctttgggcagcggcagacccctaagaagcggcgaaagtcgcgcacggccttcaccaaccaccagatctatgaattggaaaagcgctttctataccagaagtacctgtcccccgccgatcgcgaccaaatcgcgcagcagctgggcctcaccaacgcgcaagtcatcacctggttccagaatcggcgcgctaagctcaagcgggaactggaggagatgaaggccgacgtggagtcccccaagaaactgggccccagcgggcagatggacatcgtggcgctggccgaactcgagcagaactcggaggccacagccggcggtggcggcggctgcggcagggccaagtcgaggcccggctctccggtcctccccccaggcgccccgaaggcccccgggcgctgcgccctgcagctctcgcctgcctctccgctcacggaccagccggccagcagccaggactgctcggaggacgaggaagacgaagagatcgacgtggacgattgagcggcgccccgggtcttccgccgccctgggctcctagcgctcgaaagcccaacgcctcccggaccggaccgccgaggggagctgggacctcctctgccactcccgcctcctcccctgtccccggactcggctcctggcagccgcctcttccctctcgaagcaataaacccaggctggccggccgggccggccgccaccagcggcctccgccgccccggaagccctcgccgagcaattctgtatggcttctatataaatatttaaacctatatagcgggttctcccc

SEQ ID NO: 65156 - DNA, 381 bp, Homo sapiens
ccaccagccactcagtctttgaacccagcaatctctctcagcctcgatggctttgcactttctgttctccctggatacaatgttcttgcattctgactctttgcatagttggtcctcccaactttcgaaacaggcttaaatatcagttccttatagaagtatttcctgacatcatagcacttaccacaggctgcaattatgcatttgttcatttagtgtgtgtgtgtgtgtgtgtgtgttttaactgtgtggcttacatgggaatgcaagcttcgtaggattagggacgtgtccatgtcctccttgttgcatgcccactgccaagaatagtgtctggtgcatgataaatacttgtttcatgaattaattaatatactattt

SEQ ID NO: 65157 - DNA, 378 bp, Homo sapiens
tccaaataggcccctcctacttcttggcaatcatcttattaattgcatttttctgttgtctcatattccttcttcctctttaactcttaatagatgccatttacttctatataagtgaaaaaggacaacagggtacaagcttgcactccagcctgggcgacagagtgagactctgtctcaaaaaaaaaaaaaaagactccagacagcttgttagctctttcttccacatgaggttacagcaaaaagacagatgtctagaagctggcccttaccagatactgaatctgccagtgccttattttggacttctcagcctcctgggctgggtgaggtggttcactaccagccttggcaccatagtgagactcccatctctac

SEQ ID NO: 65158 - DNA, 477 bp, Homo sapiens
gtgttatacttcgataaaattgacatttaaaacatttataaggaagcaaagtgccttgtgagctcagaggatatagcaaggaatggtttttgacttgagcctcagtgaccagttgccttctgtcctgccttggtgtctgactgaccactggctttcttctccagaggccaagtgtatcatctgatgatgccagctgccctcacatggctccaaaaattccttctttctttccttccttccttccttccttcctctctccctctcttttttttttttttcagagttttccttttgttgcctaggctagagtgcaggggcgcgatctcgactcaatgcaacctccgcctcccgggggtttaactgattctcctgcctcagcctcccgagtagctggaattacatgcatctgccaccacacctggctgattttttgtatttttagtagagatgggtttcaccatgttggccaggctggtc

SEQ ID NO: 65159 - DNA, 450 bp, Homo sapiens
tgcgttcgaggctggcgtcctgggggcccagggcgaccttggcccctggaatcgcagctggcagagccttctaacgggcctcggggcgccggcctgagccccgctccacgtcctgggtccccagactctttacccgcgggcagtctatgaccccgacccccttcaggcctctggtggaggcagctggtggcaagggggtcggggctgtctagaagctgctttggcggagcaagtaccttgagtggagtcggagggtcgcgtccgcaagatgtcctttgcaggccgttgcgtcctgagagccaccgagtctggatctctggatctctggatgcattttgcacagatgtcacctccctgatgccctaacccacctttcccgagtgattacatttcacaccccctcccccaaaaaagatagttaaaatataggcccagtctcattctgagcag

SEQ ID NO: 65160 - DNA, 329 bp, Homo sapiens
tgaaacggggtctcactatattgcctaggttggtcttaaactcctgggctcaagcgatcctcctgttttggcctgccaaagtgctaggattacagatgtaagccaccgtgcctggcctcaatctttatatacattttgattttaactcttcggttaatcctgcaagggaggtaaggttatctccacattaacagatggggcagctgaggcccagtaaaggaaagtaacttgcccaaggtcacccatgaatacagagcagaactagggtttgagctcaggtccgtctgaagctccctctctccaccagaataacaaggaatagccctctg

SEQ ID NO: 65161 - DNA, 857 bp, Homo sapiens
aagatctcttttgaaatatactgttagtacaatcgatggttggcatcacaaattgaagattacggcagatgaaatacccatacgccttaagtgttataaattccaaccacaaagagtttctgaaaggaattgctactactaacatactctgcaagaaatcctgacttcaggattattattgttgcagatgtaattaaaatgaggttataataaattagagtaagcccttaactcaaaacaattggtgccattataagaggatgaccatgtgaagacacagacacacagaaaaaacaccatgtggtgactgaagcagagattggtgtaatgcaactacaagtcaacaagcaactatgattgacggccaccaccaaggctaggaagaggagagaaaaatatatatatctcaagaaagaaaaaatccagcacctacggcataatgtaaggagagaatgctccagcaaaatctaacttgcacaataaatctgttctgtcagatccttgaccggtatgtttatgttgacctctttccgtttgaagagagaggaaagaaactggtgttgatcaaaggttacagcagaataaaaaatatactgggacacgaaattgtgacatgtatttcccccaccagtcaggactctatgttcaatatttttatttcattatgcttacaaaagcaaatgaatgtccctttgtatttccttaagaatgaaaagatgaatgtttctttctttgcaagttccatggaagctaagaaccttaatactataaacattttaatgcttgataatggttctgtcttcaaaatgcaaaacgttttattctgacaaataaaaactctaaaaaaatgaatgcat

SEQ ID NO: 65162 - DNA, 824 bp, Homo sapiens
caagaatgaagtgtcaatgaaccatgatatactggagccaaagcagaatttatttcatccggataaatctaagggctgtcgtctgtatcttaattgtgagtcaagtgaaggccactggctctcttcagactcacagttaacagtattgttgcagatgtaattaaaatgaggttataataaattagagtaagcccttaactcaaaacaattggtgccattataagaggatgaccatgtgaagacacagacacacagaaaaaacaccatgtggtgactgaagcagagattggtgtaatgcaactacaagtcaacaagcaactatgattgacggccaccaccaaggctaggaagaggagagaaaaatatatatatctcaagaaagaaaaaatccagcacctacggcataatgtaaggagagaatgctccagcaaaatctaacttgcacaataaatctgttctgtcagatccttgaccggtatgtttatgttgacctctttccgtttgaagagagaggaaagaaactggtgttgatcaaaggttacagcagaataaaaaatatactgggacacgaaattgtgacatgtatttcccccaccagtcaggactctatgttcaatatttttatttcattatgcttacaaaagcaaatgaatgtccctttgtatttccttaagaatgaaaagatgaatgtttctttctttgcaagttccatggaagctaagaaccttaatactataaacattttaatgcttgataatggttctgtcttcaaaatgcaaaacgttttattctgacaaataaaaactctaaaaaaatgaatgcat

SEQ ID NO: 65163 - DNA, 426 bp, Homo sapiens
gacacagacacacagaaaaaacaccatgtggtgactgaagcagagattggtgtaatgcaactacaagtcaacaagcaactatgattgacggccaccaccaaggctaggaagaggcaaggaaagattctactcaaatactcaaattcttggaggaaacctggccctgctaatgcctgtattccagacttctagcctccagaagtagaacaatcaatttctgttgttgttttaagccacccagtttgtggtactttgttatagctgtcctagggagctgatccagcactcagctgggctcaaagctcaatcagaggagaagggacagttctgaaccagaatatacttggtcagctctcccacagtctcctggtcattggacgatgttagcccttgatttcagccaaggacctccattaattcaagtta

SEQ ID NO: 65164 - DNA, 529 bp, Homo sapiens
  misc_feature (18)..(19): n is a, c, g, or t
  misc_feature (21)..(22): n is a, c, g, or t
  misc_feature (55)..(55): n is a, c, g, or t
ccctcttatccactattnntnnggtttttaaaaaaatgagggggaattttttttntttgagagaaaaatatatatatctcaagaaagaaaaaatccagcacctacggcataatgtaaggagagaatgctccagcaaaatctaacttgcacaataaatctgttctgtcagatccttgaccggtatgtttatgttgacctctttccgtttgaagagagaggaaagaaactggtgttgatcaaaggttacagcagaataaaaaatatactgggacacgaaattgtgacatgtatttcccccaccagtcaggactctatgttcaatatttttatttcattatgcttacaaaagcaaatgaatgtccctttgtatttccttaagaatgaaaagatgaatgtttctttctttgcaagttccatggaagctaagaaccttaatactataaacattttaatgcttgataatggttctgtcttcaaaatgcaaaacgttttattctgacaaataaaaactctaaaaaaatgaatgcat

SEQ ID NO: 65165 - DNA, 450 bp, Homo sapiens
ttgttatatattattacagaatattttatttcagctggtctttgtaatttgaagagaatataggagaaacaaaatagtcagatctaccatagatgggacatttcaatacaccaaaatggcttattcaactcttgcagatggaaagttccatggacctttacacaaggagtttttctttggcctgaacctgtctttcctcatggtcacttataaattaaatatgaatacaaatataataggacttcgcttcattttgaagtgtcttgaagctaattatgattttatattttagaatcattgggtatctaccccatgcaggcttagttgaagtgatagccttttggcttttctgtgtatgatttgtttttatgtaaattatgtagactagataaatgtttatttatttttaaatgtcagttcatagggagtttctgatagggctatggataa

SEQ ID NO: 65166 - DNA, 193 bp, Homo sapiens
ccagcaccgaaaacacacatgtgcaagcatgcacacacagtaaacagccagaatgttgagtttggggtacctgtggaaaagctcagtaggagttgaaatatgggctcagcatttaggagcatgagacatgagggaataggtaatttcgctgagacacagattggaagtggacttgctgtgagaacagatttat

SEQ ID NO: 65167 - DNA, 403 bp, Homo sapiens
gctcagaacacttacattagccagtccaaaaaaaaaatctaacctaaagcctatttttaaataaagtgttgaatatcacatgtaaattattaaatactgaatgtgaaaaacggaatgggtatatgggtaataaaagcattgtttctactgaatgtttatcacttttgtaccatgataaagctgtaaagttgtaccattgtaaatctgggaccatctgtgttacattcaagagaaaagctcagtcgaactaataaataaatcaaaatttcttctgattatttaggtgttttttcctgttagataattaagacatccaactgttgcttgctgcttcaccacacagaccatacacagatacaaatacacactccatgaatgagcatatgtgcttgtttaaagagac

SEQ ID NO: 65168 - DNA, 522 bp, Homo sapiens
tttttttttttaaaaaaaggacatcactgaacatggatcaatctgacaaaggttcaatctacagagggagggagtgagctatccaaccaggaacacagttgaaggaatgaggtggaactgtacaatccctgcagtcctaaaacatagctctaggaaactgccactggctatgtccaaggtcttggagacttgttttctaaaaaatgaatgcattttcgtgggttgaaaatttctttttgcataatcaggtaatgctttttcattttttataggcaatgtctttctctgttgcccaggctggaacacagtggcgtgatctcagctcaccgcaacctccacctccagggttcaagcaattctcatgcctaagcctcccaagtagctgggactacaggtatgcaccaccataatcagccgatttttgtatttttattataatagagatggggttccctaggctggtctcggtcgacgccgccgcgaatttaatagtagtagtcgaaccgggaattccgggacggt

SEQ ID NO: 65169 - DNA, 562 bp, Homo sapiens
agaagtgctgagacactggagtctaccctgaaagataaagcttcacctgaggagatctgcaaattagtagctttttgccagaaggcattctccagtctatgcagctcaagtaatagaaggctacagccttggtggaatgacttgagggaacaggggactgagtctaggaccatcagatcagccaataagtatgtggaaaatagcagaggacagtgaccacaaaatctgcatatgaaattcaccaaaaacctttaccacctctatttgtggcataagggagacctcagaggatcctgtaaaagcatagaagctagaaactgaaaagaattaagcagaaatttcagctgatatccactgcaggagaaacaggattgggaatttgtgtccagccatgatatccacttgctagaaaatatgtttgaagggacataaaagaatacagaatctctacaaaatatcattcagaacacccggtattcaatcaaaagtcactaaagaaacagaaaatggtgacacttatttaaaaaacaaaataaaaaaacagagaatggtcaataggaac

SEQ ID NO: 65170 - DNA, 139 bp, Homo sapiens
gaaggggggctgcacgttacagatgagggagcaacacttgatggccttctcgtcccgaggcaccagccagcccgaccccgcaactgccgcggcgggcgggcgcggaactgcggggaagccgaagagtccaacctgctca

SEQ ID NO: 65171 - DNA, 451 bp, Homo sapiens
atgaggaggttggactcatctctctgatttctcatggtgctaaaaggtcaacaaggctgggtgtggttgctaagtttgtaatcccagcactttgggaggctgaggtgggaggatcggttgagcccaagagtttgagtctgtagtgagctgtgattgttctgctgcactccagcctgggcaacagagtgataccctgtctcaaaaaaagtgttaggtttgtgggtagccttcttttgattgcagagtgctttcttttctccatactgacgtctgttctctacacgtggtagacccatctcctcagtggtgtatgaagtgagttgagagattgaaaagcccagactggagtttttgtcattctaagatctttagggccatatgggacctgaatttccttctttctcttttttttttttttctgagatgaagtcttgcactgttgcccgggctg

SEQ ID NO: 65172 - DNA, 445 bp, Homo sapiens
ggttcaaaaggaccaaaaagcagatgggtcacttgtaagcccctaacatacagtgtaaaggccttgcctcaaatacccctgagcatccccactccaaacattaatatctaacatttattgagtgccagaaaagttccggacattatcctaagcccttttacttgggttatttcattttatctttaaaactccactgtcacagtcatgcattgcttaacgacagtaatatgttctgagaaatgcattgtcaggtgatttcgtcattgtgcaaacaccatagagtgcacttgcacaaacccagagggtatagccttctacccacctaggttatgatctattgttcctaggctacaaacctgtacaacgtgttactgtactgaatactgtaggcaattgtaacactatggtatttgtgtatctaaatatagaaaaagtatagtaaaaa

SEQ ID NO: 65173 - DNA, 2407 bp, Homo sapiens
cttctccacgcccctgcgctctgagtcctggctctggcgctgagagagagacgccctggaaggtctgtatcagcgtctgtcgcgctgggacccacactggcttttaaggaggacacccggacacctggaagctgggaaatggactcagtggcctttgaagatgtggctgtgaacttcacacaagaggagtgggctttgctgggtccatcacagaagagtctctacagaaatgtcatgcaggaaaccattaggaacctggactgtatagaaatgaaatgggaggaccagaacattggagatcagtgccaaaatgccaagagaaatctaagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcgtatgaatgtaagcagtgttccaaagcctttcctgattacagtacctatctaagacatgagagaactcacaccggagagaaaccctataaatgtacacaatgtgggaaagccttcagctgttactattacactcgactacatgaaaggactcacacgggagaacaaccctatgcatgtaagcaatgtgggaaaacgttttatcatcacacaagctttcgaagacacatgataaggcacactggagacggaccacataaatgtaagatatgtgggaaaggctttgattgtcctagttcagttcgaaatcatgaaactactcacactggagagaaaccctatgaatgtaagcagtgtgggaaagtgttatctcatagctcgagctttcgaagtcacatgataacacacacaggagatggaccccagaaatgcaagatatgtgggaaagcctttggttgtcccagtttatttcaaagacatgaaaggactcacactggagagaaaccctatcaatgtaaacaatgtggtaaagccttcagtcttgccggttcccttcgaagacatgaagcaactcacactggagtgaaaccctataaatgtcagtgtgggaaagcctttagtgatctctcttcctttcaaaatcatgagacaactcacactggagagaagccatatgagtgtaaggaatgtgggaaagcattcagttgtttcaaatacctttctcaacataaaaggacccacacagtagaaaaaccttatgagtgtaaaacatgtagaaaagccttcagtcatttcagtaacttaaaagtccatgaaaggattcactctggagagaagccatatgaatgtaaggaatgtggaaaagcattctcttggctcacttgccttctacgacatgaaagaattcacactggagagaaaccctatgaatgtctacaatgtggtaaagccttcactcgttcccgtttccttcgaggacatgaaaaaactcacactggagagaagctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcctccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgcaggcccacctacgtggtatatgtcacccagaacattaaaatttgttttaacattca

SEQ ID NO: 65174 - DNA, 1216 bp, Homo sapiens
cttctccacgcccctgcgctctgagtcctggctctggcgctgagagagagacgccctggaaggtctgtatcagcgtctgtcgcgctgggacccacactggcttttaaggaggacacccggacacctggaagctgggaaatgaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcctccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgcaggcccacctacgtggtatatgtcacccagaacattaaaatttgttttaacattca

SEQ ID NO: 65175 - DNA, 1404 bp, Homo sapiens
cttctccacgcccctgcgctctgagtcctggctctggcgctgagagagagacgccctggaaggtctgtatcagcgtctgtcgcgctgggacccacactggcttttaaggaggacacccggacacctggaagctgggaaatggactcagtggcctttgaagatgtggctgtgaacttcacacaagaggagtgggctttgctgggtccatcacagaagagtctctacagaaatgtcatgcaggaaaccattaggaacctggactgtatagaaatgaaatgggaggaccagaacattggagatcagtgccaaaatgccaagagaaatctaagaagtcatacatgtgaaattaaagatgacagtcaatgtggagaaacttttggccagattccagatagtattgtgaacaagaacactcctcgagtaaatccatgtgacagtggtgagtgtggagaagtcgtcttgggtcattcgtctcttaattgcaacatcagagttgacactggacacaaatcatgtgagcatcaggaatatggagagaagccatatacacataaacaacgtgggaaagccatcagtcatcagcactccttccagacacatgaaaggccccccaccggaaagaaacccttcgattgtaaagaatgtgcaaaaacctttagttctcttggaaacctccgaagacacatggcggcacaccatggagatggaccttataaatgtaagttgtgtgggaaagcctttgtttggcccagtttatttcatttgcacgaaagaacacacactggagagaaaccgtatgaatgtaagcagtgttctaaagcctttcctttttacagttcctatctaagacatgaaagaatccacacgggagagaaagcctgtatgaatgtaaggaatgtgggaaagcattgagttctctccgttccttgcatagacataaaaggactcactggaaagatactctctaaatgtatggaatgtgggaaaacattcagtactttaatttcagaaacttgaaagaactcactttggagatagaccctatgaatgtaaacatgggataaagccttaagtagtttcaatttttttaaatacagttatcccccaatatattgcaggggattggttccagcaccctctaaatccacagatgccaagtcctttgttatatggcatatttgcatgtaacctatgcatatcctccagtatactgtgtaaatcatctctagatgacttttaatacctcatgcattgtaaaagctatgtaaatagttgtttgattgtattgtttagagaatcatgacaagaaaaatagtctctacatgttcgatgcagacacaaccattgcaggcccacctacgtggtatatgtcacccagaacattaaaatttgttttaacattca

SEQ ID NO: 65176 - DNA, 336 bp, Homo sapiens
ggaacacagggcctgaccacccaggagcagccacgggaagacagaagacacgtggtcacacatgaggacacaatggcacccgtgccccaagctctgcacagaggacacttggtcacacgtgggaacaggatggcacccacaccccgagctctgtgccctgatcactgtcacctcccaggcactgcctcactgaggacaacggactggcccgtgtggctggcggccggcacgtaggctaggtcagatgagagccaccctgggacccaaacccccacaggcccccagacccaatccccgatcacacagaacaagccactaagcgtgtgtcccagaaaa

SEQ ID NO: 65177 - DNA, 1145 bp, Homo sapiens
gccaagaatccatatttctttaccagactaggaattctattctagtgcaaatgccttaaaaagcttatcactaaatcattacgaatgtgtgccatccgtggaattgcttttttttttttttttttgtaaatatgaggtctcactatgttgcccaggctggtctcgaaatcctgggcaatcctcctgcctcaccctctcaagtactggaattacaggcgtgagccaccgcgcccggcccaagtatcacttatggtttcagaacgccattattagtgtctgactgtcttggtcttcttatacattgattcccaaatcacgtgtggtaacagcatctcaatttttcatgatgacggtttgaaccattaatttaattcctcaggctatctacttttttgttaaacatactgtgtagaccatcttttttttttcccatcatgatagtcaaaattttagtctgtgtattcaagtgagaaaatttttagtcagcattatacaagtagtatttattatgtatacattcagtggagttgtttctacaaaagtatttcggaatgactattctgctgcaaacttttgtgtaagcgcttcaccttattcctacaataaggagaagtgcactaacaaaatgaacaatgcagcaagggcttcagtcgcagctcaggtcttatcaaacaccagagaaccctcaatgggagaagccttatgagtgtgacaactgtggaaagacagttccttttttgttagtatcacttctacttattgtagaaatatgctttcattattgcatctactcacatttctcactcggtttctggcaccagcaatctcttccatatttataatatcagtcaaaaactctggaattcaaatataacaagacttttctggtcacctttgatagttaatgacttgggcattgtgatatattatctcctgctgtatgtattttgtttagtagaaattgaatcattatccacaatcctttatagaactatccaagtccctgtttttatgctagtttccaaggcttggtccttcaaggttttcagggatctaggggacacaaatctaacaaatcctaatgtatattatttgtattatagtaataaaccatatggttactttgtttgagtggattcttaaat

SEQ ID NO: 65178 - DNA, 1045 bp, Homo sapiens
ggcgatagtttgttgagaatgatgagacgaggtttcactgtgttagccaggatgctctcgatctcctgacctcgtgatccacctgtctcggcctcccaaaatgctgggattacaggcgtgagccaccgcgcccggcccaagtatcacttatggtttcagaacgccattattagtgtctgactgtcttggtcttcttatacattgattcccaaatcacgtgtggtaacagcatctcaatttttcatgatgacggtttgaaccattaatttaattcctcaggctatctacttttttgttaaacatactgtgtagaccatcttttttttttcccatcatgatagtcaaaattttagtctgtgtattcaagtgagaaaatttttagtcagcattatacaagtagtatttattatgtatacattcagtggagttgtttctacaaaagtatttcggaatgactattctgctgcaaacttttgtgtaagcgcttcaccttattcctacaataaggagaagtgcactaacaaaatgaacaatgcagcaagggcttcagtcgcagctcaggtcttatcaaacaccagagaaccctcaatgggagaagccttatgagtgtgacaactgtggaaagacagttccttttttgttagtatcacttctacttattgtagaaatatgctttcattattgcatctactcacatttctcactcggtttctggcaccagcaatctcttccatatttataatatcagtcaaaaactctggaattcaaatataacaagacttttctggtcacctttgatagttaatgacttgggcattgtgatatattatctcctgctgtatgtattttgtttagtagaaattgaatcattatccacaatcctttatagaactatccaagtccctgtttttatgctagtttccaaggcttggtccttcaaggttttcagggatctaggggacacaaatctaacaaatcctaatgtatattatttgtattatagtaataaaccatatggttactttgtttgagtggattcttaaat

SEQ ID NO: 65179 - DNA, 528 bp, Homo sapiens
ctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaa

SEQ ID NO: 65180 - DNA, 1176 bp, Homo sapiens
  misc_feature (1093)..(1093): n is a, c, g, or t
  misc_feature (1112)..(1112): n is a, c, g, or t
  misc_feature (1126)..(1126): n is a, c, g, or t
  misc_feature (1138)..(1138): n is a, c, g, or t
  misc_feature (1142)..(1142): n is a, c, g, or t
tggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgtttgccaaggcaccttgctgccttncagcaaccctggggattgnttgcccacatttgncaggttgccatntttnttttggccatttggttggggattgggtttttgtt

SEQ ID NO: 65181 - DNA, 932 bp, Homo sapiens
gtcgccctgacactcaaggcccttcattgccacatgtctcaggcttcagccaaacctgcttcctctggccccaaatgacacctccaggcagactgaggcagacctcccccaaccaatggcccagctcccgcccccaccctgcacacatacacagtgtcacccgttctctgtttgcagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagcccactttgtacatgtaatgtattatatggggtctgggctccagccagagaacaatcttttatttctgttgtttccttattaaaatggtgtttttggaaaaaaaaaaaaaaa

SEQ ID NO: 65182 - DNA, 1182 bp, Homo sapiens
  misc_feature (23)..(24): n is a, c, g, or t
  misc_feature (26)..(27): n is a, c, g, or t
tcaggagatgatgaggagaccanncnncactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatactgcccattgagggcctgctcagctctggcaaacacttctttgttgagctcagtactgacagcagcggggcagctgcaggcatggccctgcgctatgagggtgagcctgctggggcctcactgggggtggcgggtccacggggatgggctcgggcctagggtctttctcccacaccctacccctctctgcctccatgctgtcactccttccaagtcagcccctgctcactcagtacttaggccccctttccctgcccctctctttgggtccgggatccctaccacagctttgcaggaaacctctgcctggacccaggccctatggtccaagggaataaattctccagattttga

SEQ ID NO: 65183 - DNA, 1789 bp, Homo sapiens
tggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggccatgtcagggggcatctacctgtgggaagaacatagctgggagcacaagcatcaacagccagcatcctgagcctcctcatgccctgggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctggg

SEQ ID NO: 65184 - DNA, 1162 bp, Homo sapiens
  misc_feature (23)..(24): n is a, c, g, or t
  misc_feature (26)..(27): n is a, c, g, or t
tcaggagatgatgaggagaccanncnncactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagcccactttgtacatgtaatgtattatatggggtctgggctccagccagagaacaatcttttatttctgttgtttccttattaaaatggtgtttttggaaaaaaaaaaaaaaa

SEQ ID NO: 65185 - DNA, 664 bp, Homo sapiens
cctggttctcacggctcccaggtcatgggcttcccaaggagggagggcagagaaagagagaggtttgggcctagcaggttaaaaagctccttccctacacccagccagctagagggagctggtagtcagatgcccttgggcagaggtgagagaatatgggctccaggtgacagagacctctgctccagtcacaccctctgtgtcttcagttgccaaggcacctgctgcctccagcaccctggatgctgcccacattgcagctgccatcttcttgccactggtggcgatggtgttgttggtaggaggtgtatacttctacttctccaggtgagtctggcttctctttctgctctgcatacctgcatacctcactcctacccagtgctcctgacttgcaggcttctctgccccacaggctccagggaaaaagctccctgcagctgccccgcccccgcccccgcccctacaaccgcattaccatagagtcagcgtttgacaatccaacttacgagactggagtaagtaaccatgccagccttgccaccctatccaagacccagttctttgcttctttgggcagataaccctgagggtcctgccaagccctctcactttttcccttttcctagggaaggtgaattatggcctggcaaacctaatacaa

SEQ ID NO: 65186 - DNA, 1799 bp, Homo sapiens
ggcacgaggcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaa

SEQ ID NO: 65187 - DNA, 1491 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtctttcatcatccgaggcctgcgttcagttggtgcttccagacaccaagggcccttgtgaatcccatcctggaagggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttttctcaagtgttacctactaagagatgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgttgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaaaaaaaata

SEQ ID NO: 65188 - DNA, 799 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactggggtaaggatgagttccaccactttttgatgctttcttgtctgtcaagttcagaacttcctgccttttactcctatatcccaaaacttgttttccacacttcatgggtttctttctttcttttgaaag

SEQ ID NO: 65189 - DNA, 1153 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtctttcatcatccgaggcctgcgttcagttggtgcttccagacaccaagggcccttgtgaatcccatcctggaagggaagggctgactgaaaccgtggctaagaattgggagactctcttgtttcaagccaatttaacatcatttaccagatcatttgtcatgtccagtaacacagaagcaaccaactacagtatagcctgataacatgttgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaaaaaaaata

SEQ ID NO: 65190 - DNA, 1047 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtctttcatcatccgaggcctgcgttcagttggtgcttccagacaccaagggcccttgtgaatcccatcctggaagggaaggtgcatcaccatctacaggagaagaagaatggacttgctaaatgacctagcactattctctggcctgatttatcatatcccttttctcctccaaatgtttcttctctcacctcttctctgggacttaaggtgctatattccctcagagctcacaaatgcctttcaattctttccctgacctcctttcctgaatttttt

SEQ ID NO: 65191 - DNA, 1435 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtctttcatcatccgaggcctgcgttcagttggtgcttccagacaccaagggcccttgtgaatcccatcctggaagggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttttctcaagtgttacctactaagagatgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgttgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaaaaaaaata

SEQ ID NO: 65192 - DNA, 1232 bp, Homo sapiens
ccgtctgtgggcagtagcaccagtgctggtgctgaggacgatgctctgctccccgcggaagctctaccaggcctcgctgctgcggagcatgcgaagaagatgcacactccaactctactgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtctttcatcatccgaggcctgcgttcagttggtgcttccagacaccaagggcccttgtgaatcccatcctggaagggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttttctcaagtgttacctactaagagatgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgttgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaaaaaaaata

SEQ ID NO: 65193 - DNA, 529 bp, Homo sapiens
  misc_feature (75)..(75): n is a, c, g, or t
  misc_feature (82)..(83): n is a, c, g, or t
  misc_feature (90)..(90): n is a, c, g, or t
tttgaaattagtacagacttacttttttattttaaaatttttgctataacatttctgagccaaaggcagagggtntccattnncttcatngttgccttaattgagggatgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgttgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaaaaaaaata

SEQ ID NO: 65194 - DNA, 722 bp, Homo sapiens
tgatgaaagaattaagtgaaagatgaatcttaggaagcagaaggaagtaaacctaatctctgactaagaaagctaaataccataataactcattcattccttcttttgttcaattacattatttaatcataagtccgtgatgtgccaggcactcaggaaatagtaaaaactggacatgtgatattctgcccttgtgtagcgcacattatagtgggaaagaaagcgcaattttaaccggacaactaccaacaataagagtggaggaagcaggggttggaaatgtccacaggctgtgccaaagatgaagcccgtaatatttgaaagtcagtttctttcatcattttgtgtattaaggttctttcttcccctgttctccaccttcctgcttgtcatcttcactcatcagctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatggtatgtgtcaacaattctgcccctctttactgatttatcccttcataccaagtttcattattttatttcc

SEQ ID NO: 65195 - DNA, 756 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtgggtgagtgtatgagtgagggatgttctctggagctggaagagaggaaattgaagcaaaagagagaaagcgatttgcagagaaattgtagagatttcctaagggtcccttcagtattaagagatttaaaaattatggctgttcctccttcaggaaaccagagtcccaacctactctttttgttatctatgctgttggcgttcactaaggatgctattctgtttatattgtattcagtgactatagcctggaggtctctatgtcattccatcatgattgcctcaaaaattagtgaggtttccatcaatggataattttttattattaaaaatttgtgaagtatcattctcaaatttccctgaacaacttttgaagcttttcggatgtctcctgtagtagcgcttggggtaaatgattccatcaattatatactctatagatattaagaaagatgcccttttctttctctcagacttactaacatttccacgtgggaactggcacaggtggggagtgggtaaaggagtccagcaggctgaatgccttcaacaatcattttaccacatggtcctcacttactctcagctgcctcatatgtgtcacctcacaaataa

SEQ ID NO: 65196 - DNA, 1245 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtctttcatcatccgaggcctgcgttcagttggtgcttccagacaccaagggcccttgtgaatcccatcctggaagggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttttctcaagtgttacctactaagagatgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgttgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtactaaaaaaaata

SEQ ID NO: 65197 - DNA, 872 bp, Homo sapiens
cgaggtcctcacaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactttggtctgcgccctggggttgtctgtgggcctcatgggcattgtggtgggcactgtcttcatcatccaaggcctgcgttcagttggtgcttccagacacaggcatgtgtatcatctgaaggaaggtgcatgcatgatcagagcagagatgactgcata

SEQ ID NO: 65198 - DNA, 451 bp, Homo sapiens
ttttctcacatggtatcgttataacattataatatttcttagtatctcccaaattgtccttaaggtaaaactattttaagtttggcagctttgaacaggacatgtctatttaaatattcttttctatctaaatataggttgacaagcatgggtcacccactagttacaaggaaggataccataatatatagctatattaagagatagagtacaaagtgtatattcacatataggtatatgcaaatgacaagaagttactcctaatgagtctttagtactcttgtttcatagtgtaagctagctgttgggtaacttctactacagagtgcagatattagtggatgcttgcttaaaatcttcttgaaccttttttttttttcttgtgaagcttatgttttaaagtatcctttttgtgacacatcaggcattatagcaaatttatgtgaggtct

SEQ ID NO: 65199 - DNA, 387 bp, Homo sapiens
agtcgctctgcagagttgaattcaggctgctgcagcggccaggaagcagggacacgccgtgggacatgtcagccagtgcgtcactggcaagcttggtatgtaacgtgcaatccttacatggattctgcaaaacccactggcatgcctatgccaaatttataaacagtcaaaagccaggcggtgaaccgctccggaccccacggagcaggggccacctgatagcaacgtgagaagcattctcgctgctgctgggcagcaccactcaactctcccaggataaagcacttgaagaatctcttgtgattcttatcacgggcaaaacattctaatcgaacttttcaaaactgcagtttgaatgacacaagacgggccagaaccccttgattt

SEQ ID NO: 65200 - DNA, 365 bp, Homo sapiens
tttttttctccccaaatatccaggtggattcaataaagataacctgaaatttgcatactgtttttactcagagagaagcagcactaattccattttttatagataagaaaattgagatgcagagatattaaaacatttaataattgccctgattttgaagaacaaaacagatgtgagtaaaaagagctgctaattggaaaaaaacaaagagccaaccagactaaggtgaaaagagctctagacattatttcaatttttactcatgaaagtcagatctaaatattgaccattttatttggtatcagaaattattttgtacacacgtttttagtaaaatagaattgattaattcttcctatgatcaa

SEQ ID NO: 65201 - DNA, 353 bp, Homo sapiens
caagttactgacagtactatttgcatagttctggtcactttccaaattacctctcactcagcctcaccacagcccttatccacagagccacctggggtggaatgggaggggcttttcttatccccatccaacagatgaggagactgtgactcagagaggtgaatgacttgggcaaagtctaacaacagtaaccacagagtaatgatttctaagctactaattaactttctaaccatctacccataaggaattggcctgtaggttgaaaaggcattcctgagtctctgtataccacacaccaaggattaatattccaagtaatcattttagaatttaaaagtgcaatagttaaa

SEQ ID NO: 65202 - DNA, 2193 bp, Homo sapiens
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcggtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcaggtcgtcgtcccgcagacacacaatccagaagtcactttcctcgagacattggtcagcccatcactcccagccactcgaagctcacccccaagctggaaactatgactcttggaaacaggagtcacaaagctgcagaaggcagccactatgtggatgaagcctcacacgaggggagctggtggggaggtgggatttagtgcacagcctcacgtggggcttggacacaggctgggggtgggcgcatgctagggagactagcctgctgctctctgcattccttagcgtcttgtttgacctgcttgcttccagacataacctgcatgaatcagttttgggggaatggacctggcatggggatgggttcaggccaggtcttttgatggccaggagtagatgacagggagttgccttggggaacctttggtgtgccaagaggaggtgggtagatgggagtggggctcggtcccccaggcccaggggactctctccactctttcctgggctcggggcatctgcctggagttaccttccatcatggctacctgctgtggtttgaatgtttgagtcccaacaaaattcatatcaaaacataatcccaactgggtgcagtggctcacgcctgtaatcccagcactttgggaggccgaggcgggcggatcaataggtcaggaaatccagaccgtcctggctaacatggtgaaaccccgtctctactaaaaaaaaaaatacaaaaaattagccgggcgttgtggcgggcacctggagtcccagctactccggaggctgagggaggagaatggtgtgaacccgggaggtggagcttccagtgagccgagatcgcgccactgcactccaggctgggcgacagagcgagactccgtctcaaaaaaataaatacataaataaaaaataaaccacccat

SEQ ID NO: 65203 - DNA, 1511 bp, Homo sapiens
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggttccgccggtccacgccacctcccttcaatggcaccaggtgattcctcaacttgggggaccctagttgatccctgggggccccaggacatccacatggagcggtccatactgagacgggtgcagctgggacacagcaatgagatgaggctccacggcgtcccgtccgagggccctgcccacatcccccctggcagccccccagtctctgccactgctgccggcccagaagcttcgtttgaagcaagaattcccagtccaggaactcaccctgagggggaagccgcccagagaatccacatgaaatcgtgctttctcgaggacgccaccatcggcaacagcaacaaaatgtctatcagcccaggggtggctggcccaggaggagtcgcagggtctggagagggggagccaggggaggacgcagttgctgccttcactgaagtcttgaacccctcaaagtcattcatgaaatttggaatcaacttcttccagactcctgtgaatgttgatagtttgacctcctcccatgaatcacaaatgttcttaacggcatgtagattggtgatcttttccagaagattttcaacttactttgcccagatccatctgaggaatcactctgtgttgcacttatgccctcataaaatatatttattgaagaata

SEQ ID NO: 65204 - DNA, 1031 bp, Homo sapiens
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctggtaactgccaccccggggaggcgggtctgaccctgcagggagcatcctggcaatggacaagcacagatttgagcctgggttcgaatctgaactctgccacatgggagctcacaggtttcctctctctgtgccttggtttctttttctggttgatggagctcacagcagggctgcttggtaggggttgctgagaggaggccctgcgtcaggctcagcccagccctgcacacaggaggtactctgcagaacactaacaattataatagaaaatcatcatgatggagacagcaatgacgccatggtcccaatcacagaacatatgcagtcccaccagccccccttttctagctttacagcccacagccagaaggagctgccatttatcatgcacttaagattagccaggcactgttttggggttcacccagccctcacacaaccccaggaggcaaaggaggctgagccccggagaagttaatcggcaggaagccgcagctgccagggcgcaggcaggatttgaagtcaagtgtgttgaactctggagtctgagtttgcaactaccggcattgccacttacccctagggagctgccca

SEQ ID NO: 65205 - DNA, 1130 bp, Homo sapiens
gctgacacctgcccagtggaagctggcatccctccccttgtgggttcagagctgcaagaagcaccaggctcggccacttcagaagccccagcctcgacctagcccaccctctcagggccacagtgcagaagcctgcacacctgccaagtctctccgactccttgcagctgctgtcagcatggcccaggctcctgctgacccgggcagagaaggccaccttgaacaaagaatcctgcaggtgctgacagaggctggctccccggtgaaacttgcccagctggtgaaggaatgccaagcacccaagagggagctcaaccaagtcctctaccgaatgaaaaaggagttgaaagtctccctcacatcccctgccacctggtgcttgggcgggactgatcctgaaggcgagggtcctgcagagctggccttgtccagccctgccgagaggccccagcaacatgcagctacaattccagagacccctggccctcagttcagccaacaacgggaggaagacatctacaggtttctcaaagacaatggtccccagagggccctggtcatcgcccaagcactgggaatgaggacagcaaaagatgtgaaccgagacttgtacaggatgaagagcaggcaccttctggacatggatgagcagtccaaagcatggacgatttaccgcccagaagattctggaagaagagcaaagtcagcctcaattatttaccagcacaatccaatcaacatgatctgccagaatggacccaacagctggatttccattgcaaactccgaagccatccagattggacacgggaacatcattacaagacagacagtctccagggaggacggtaagtcacccaagagagcccagggaggggacctcggtggggagccaccggatcctctgggtgggggcaaagggtagggatggggagtggggggattctgccctccaaggggaaagggttgcttccagacccccacagtccacctttacggccgtcctgagaatgaggacacctggatcaaagctctcctgatttccctgtactctgatactttctacctcattttaaagtttaatttaatttttatttttctaataaaattttaaaattaagatggggtat

SEQ ID NO: 65206 - DNA, 323 bp, Homo sapiens
caccgcacctggtcaatgttttctattaaaattctacctaagcatctaggctctgttgggggcttatcataacttaggatgtgccaaattgggcaggtgagctgggttttcagtgccagtcccacagaccttttctcatccaaggagggatgctcccaagagtatttatactgtgctctgagtatctgggacccagaatctgaaggcctcatgagtccactacaggaagaggtctctgatggcaaggagcggtaattgatggcatcctccttctaggtctccacatgcggcaaattgctttaaatgaatgcttttgagcccct

SEQ ID NO: 65207 - DNA, 742 bp, Homo sapiens
aagactctgtttggggtactgctggcagccatcttgcccaaagaaagagagcctcatgtgggcaaaggctgatgaggaaaggaagctgggaaatgcagaggaaaaaaaaaccccagcctgttcacattgtttgcgccactagaacagctcttcctagaagtcagccctactctagacctttagattaaacgaagccgataaaataccttgcttatgtgagcagtttggattgaatttttcattatttgcaactgaaagcattcgattggaagaaaccaacagtagaagaccaaatgggacgcaaagtcagcatcgttgctgggagaggacataaagagaggaacacccagttgaaactccacaatgccttcctgttatgccccagatatggagcagctgatgtagtcacaagccttaggccttgttcttgcccctacagagcctgaagttacggaagcaaagtccaagctaaaccctggatcaagattagcagcagtactgtacaggccacagcctgtacctgtaaactggccaatcattaacccctgcttactcttgatgtgcagggagtagcgtgagagagcattggggcctgatgcaatttatgcacaccttcaggaaaactagtggcatcacctcctcatgaaggatgccagtccctcttccctctgttctgacaagttaccaacaaggccaaatgttagcttctccttgataaaataaaagaattctcattgtggac

SEQ ID NO: 65208 - DNA, 281 bp, Homo sapiens
accaaactaccaaatgggcaaacttaatcaacattaccaataaagatgaactttttgatgcaacaggacaatttaaaaaatataccatctattggtaagaactcttactataagaattcttactatacaagcctttaacaaatgctagctcattaaatacctagagtaccctctaaggtaggtattaaaaattttttaacaaatttataatagatttggcacaaataataggacaattaaaggcttgttcttcaacccggcttaaagtgaattcatcctaa

SEQ ID NO: 65209 - DNA, 350 bp, Homo sapiens
gtacatactggttaaaaaaaaaatcaaacagtactaccaaacagtagaaaatatttacgattaaaaaaaaaaagtatctttggtacccttccttagtcccctcagtaaagagacaaacatcactggtagttttctacccctgtagtaccttatagagtaattttgccttattcatcacagacaggtcacctctggacatggaattctaataacaaggacgctctatcaccaaagtcctactgttgaaccttctccagactccagtactatgacccctccatttcccttctgttctcagtcttctctcattcttgcttccttccctgctggcctacatgtagtgattcatc

SEQ ID NO: 65210 - DNA, 468 bp, Homo sapiens
attcacccatcaagatatactgagttcctcaaccctgccccggactaggctaggtttctgggatacacatgtgaacaaggtagatgcagtccccatgctctcattaacttgcattacaaaaaatcacccaagagcacgttaagacatagatctccaagtcccgctcccagattttctgacgatgcccaggagtctacacgtttaatacacatcccaggttaaataaaaagaaagaagatgactggagagtttacgtcaggaggaccccacagcctcccgagtttcctccctcccttcacactgccccttcctgagcttcccgtcatcagccctgtcatctccgtgccacgttcctgctgtggccatccccactctctcgcccctttcatgccatctctgggggtgatcccaatgtgccttcagtcgagcaactctgggttccaaataaatctatgttctcttggaaga

SEQ ID NO: 65211 - DNA, 745 bp, Homo sapiens
tttagggccattaattctgaccacgtgcctgagaggcaaggtggatggccctgggacagaaactgttcatcactatgtcccggggagcaggacgtctgcagggcacgctgtgggctctcgtcttcctaggcatcctagtgggcatggtggtgccctcgcctgcaggcacccgtgccaacaacacgctgctggactcgaggggctggggcaccctgctgtccaggtctcgcgcggggctagctggagagattgccggggtgaactgggaaagtggctatttggtggggatcaagcggcagcggaggctctactgcaacgtgggcatcggctttcacctccaggtgctccccgacggccggatcagcgggacccacgaggagaacccctacagcctgctggaaatttccactgtggagcgaggcgtggtgagtctctttggagtgagaagtgccctcttcgttgccatgaacagtaaaggaagattgtacgcaacggttaaataaaaagaaagaagatgactggagagtttacgtcaggaggaccccacagcctcccgagtttcctccctcccttcacactgccccttcctgagcttcccgtcatcagccctgtcatctccgtgccacgttcctgctgtggccatccccactctctcgcccctttcatgccatctctgggggtgatcccaatgtgccttcagtcgagcaactctgggttccaaataaatctatgttctcttggaaga

SEQ ID NO: 65212 - DNA, 744 bp, Homo sapiens
tttagggccattaattctgaccacgtgcctgagaggcaaggtggatggccctgggacagaaactgttcatcactatgtcccggggagcaggacgtctgcagggcacgctgtgggctctcgtcttcctaggcatcctagtgggcatggtggtgccctcgcctgcaggcacccgtgccaacaacacgctgctggactcgaggggctggggcaccctgctgtccaggtctcgcgcggggctagctggagagattgccggggtgaactgggaaagtggctatttggtggggatcaagcggcagcggaggctctactgcaacgtgggcatcggctttcacctccaggtgctccccgacggccggatcagcgggacccacgaggagaacccctacagcctgctggaaatttccactgtggagcgaggcgtggtgagtctctttggagtgagaagtgccctcttcgttgccatgaacagtaaaggaagattgtacgcaacgcccagcttccaagaagaatgcaagttcagagaaaccctcctgcccaacaattacaatgcctacgagtcagacttgtaccaagggacctacattgccctgagcaaatacggacgggtaaagcggggcagcaaggtgtccccgatcatgactgtcactcatttccttcccaggatctaaggacccacaaaagaaggcttacagatttaaagcatcatctgttcgattgaaattttgcaccagcgaagaattc

SEQ ID NO: 65213 - DNA, 883 bp, Homo sapiens
tttagggccattaattctgaccacgtgcctgagaggcaaggtggatggccctgggacagaaactgttcatcactatgtcccggggagcaggacgtctgcagggcacgctgtgggctctcgtcttcctaggcatcctagtgggcatggtggtgccctcgcctgcaggcacccgtgccaacaacacgctgctggactcgaggggctggggcaccctgctgtccaggtctcgcgcggggctagctggagagattgccggggtgaactgggaaagtggctatttggtggggatcaagcggcagcggaggctctactgcaacgtgggcatcggctttcacctccaggtgctccccgacggccggatcagcgggacccacgaggagaacccctacagcctgctggaaatttccactgtggagcgaggcgtggtgagtctctttggagtgagaagtgccctcttcgttgccatgaacagtaaaggaagattgtacgcaacggctgcagagggcttcacgagcatgatctcacagcacccctaggaggtgcatttgatcttcatcctccctgtgcagctgcggacacccggtctccagggtcacacgtccagccacagctgtgtgcagccccgtctcagggctccgcgacccgagttccagttcctggccaacctaccctccagctactcgtcttactttgggcaacgtcactgaacttctctgggcctggatctctgctctctgaggatgaggcagaaatcagtgaattctagcccccttggtcccctttgaaattcagaaaacaaaatatcaaggatctccacctgacagtggttctattagaatcctttggttgagaaaaatatatactagtaaaaagataccagcaa

SEQ ID NO: 65214 - DNA, 780 bp, Homo sapiens
cggacgcgtgggtcgacccacgcgtcggtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttca

SEQ ID NO: 65215 - DNA, 260 bp, Homo sapiens
gcggccgcctactactactactactgctcgaattcaagcttctaacgatgtacggggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttca

SEQ ID NO: 65216 - DNA, 1842 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaatcaaccaaaacttttcggccgctggccccaaaaatcta

SEQ ID NO: 65217 - DNA, 2210 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaaaaaaaaaaaaaaaacacaaagaagaaaagaaagaaaaaacaaaaaaaagagggggggggggcgcaaaaaaaatatatccgcggaggggggcaccaagatctaagacagccgacccgcaactcttcggtgacacaaaggagggcaccccctaaggtgcgccgacaacataaacaaccacaacagacgcagcgcgggcactacaaacacgcgtctgcgagggggaaaacagtccgccaggcgcaactgggggggaagaacccccccacaggcggggcggaagaagggcggcacacaccccaggcgaaaatgagggcccgcgggaaaaaaacaaccggcggtcagagggacaaccaccgcctaagcggaggcggaaaaagcgacaggcagagtcgaaaacattacagaa

SEQ ID NO: 65218 - DNA, 894 bp, Homo sapiens
  misc_feature (11)..(11): n is a, c, g, or t
  misc_feature (34)..(34): n is a, c, g, or t
tgagagggaanacaacataggctaggtacgaggnctgggtgttatccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaatcaaccaaaacttttcggccgctggccccaaaaatcta

SEQ ID NO: 65219 - DNA, 783 bp, Homo sapiens
acgcgtccgcccacgcgtccggaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaatcaaccaaaacttttcggccgctggccccaaaaatcta

SEQ ID NO: 65220 - DNA, 1740 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttca

SEQ ID NO: 65221 - DNA, 2155 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcaaaaaaaaaaaaaaaaaaaaaaaacacaaagaagaaaagaaagaaaaaacaaaaaaaagagggggggggggcgcaaaaaaaatatatccgcggaggggggcaccaagatctaagacagccgacccgcaactcttcggtgacacaaaggagggcaccccctaaggtgcgccgacaacataaacaaccacaacagacgcagcgcgggcactacaaacacgcgtctgcgagggggaaaacagtccgccaggcgcaactgggggggaagaacccccccacaggcggggcggaagaagggcggcacacaccccaggcgaaaatgagggcccgcgggaaaaaaacaaccggcggtcagagggacaaccaccgcctaagcggaggcggaaaaagcgacaggcagagtcgaaaacattacagaa

SEQ ID NO: 65222 - DNA, 2126 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaaaaaaaaaaaaaaaacacaaagaagaaaagaaagaaaaaacaaaaaaaagagggggggggggcgcaaaaaaaatatatccgcggaggggggcaccaagatctaagacagccgacccgcaactcttcggtgacacaaaggagggcaccccctaaggtgcgccgacaacataaacaaccacaacagacgcagcgcgggcactacaaacacgcgtctgcgagggggaaaacagtccgccaggcgcaactgggggggaagaacccccccacaggcggggcggaagaagggcggcacacaccccaggcgaaaatgagggcccgcgggaaaaaaacaaccggcggtcagagggacaaccaccgcctaagcggaggcggaaaaagcgacaggcagagtcgaaaacattacagaa

SEQ ID NO: 65223 - DNA, 2156 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaaaaaaaaaaaaaaaacacaaagaagaaaagaaagaaaaaacaaaaaaaagagggggggggggcgcaaaaaaaatatatccgcggaggggggcaccaagatctaagacagccgacccgcaactcttcggtgacacaaaggagggcaccccctaaggtgcgccgacaacataaacaaccacaacagacgcagcgcgggcactacaaacacgcgtctgcgagggggaaaacagtccgccaggcgcaactgggggggaagaacccccccacaggcggggcggaagaagggcggcacacaccccaggcgaaaatgagggcccgcgggaaaaaaacaaccggcggtcagagggacaaccaccgcctaagcggaggcggaaaaagcgacaggcagagtcgaaaacattacagaa

SEQ ID NO: 65224 - DNA, 377 bp, Homo sapiens
gaagatgcctcttctgtttcttaggctgagatggaacagtgccttgcacatacctgtgcattgatctttgtcagaattttggttcctagtgacacaacagtaggaagatgcctcttctctttcttaggctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggca

SEQ ID NO: 65225 - DNA, 1207 bp, Homo sapiens
  misc_feature (11)..(11): n is a, c, g, or t
  misc_feature (34)..(34): n is a, c, g, or t
tgagagggaanacaacataggctaggtacgaggnctgggtgttatccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcaaaaaaaaaaaaaaaaaaaaaaaacacaaagaagaaaagaaagaaaaaacaaaaaaaagagggggggggggcgcaaaaaaaatatatccgcggaggggggcaccaagatctaagacagccgacccgcaactcttcggtgacacaaaggagggcaccccctaaggtgcgccgacaacataaacaaccacaacagacgcagcgcgggcactacaaacacgcgtctgcgagggggaaaacagtccgccaggcgcaactgggggggaagaacccccccacaggcggggcggaagaagggcggcacacaccccaggcgaaaatgagggcccgcgggaaaaaaacaaccggcggtcagagggacaaccaccgcctaagcggaggcggaaaaagcgacaggcagagtcgaaaacattacagaa

SEQ ID NO: 65226 - DNA, 1599 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtgggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaatcaaccaaaacttttcggccgctggccccaaaaatcta

SEQ ID NO: 65227 - DNA, 1174 bp, Homo sapiens
gaagagctggtatccaagggacagggcagtgccaggctgaaggggcacggaggggatccgtgtccaggagaaggcagtggagggggaacgcgcagcactaagctggagggagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaatcaaccaaaacttttcggccgctggccccaaaaatcta

SEQ ID NO: 65228 - DNA, 903 bp, Homo sapiens
atattccccgagggcactactggcatcggaagcccctacgcgtcgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaatcaaccaaaacttttcggccgctggccccaaaaatcta

SEQ ID NO: 65229 - DNA, 793 bp, Homo sapiens
  misc_feature (33)..(33): n is a, c, g, or t
gcatacaatcccacactgtagtatctcccttgncgatacctctgtcactcttttcctgcttctccccagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaatcaaccaaaacttttcggccgctggccccaaaaatcta

SEQ ID NO: 65230 - DNA, 2274 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctgctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccaaaaaaaaaaaaaaaaaaaaaaaacacaaagaagaaaagaaagaaaaaacaaaaaaaagagggggggggggcgcaaaaaaaatatatccgcggaggggggcaccaagatctaagacagccgacccgcaactcttcggtgacacaaaggagggcaccccctaaggtgcgccgacaacataaacaaccacaacagacgcagcgcgggcactacaaacacgcgtctgcgagggggaaaacagtccgccaggcgcaactgggggggaagaacccccccacaggcggggcggaagaagggcggcacacaccccaggcgaaaatgagggcccgcgggaaaaaaacaaccggcggtcagagggacaaccaccgcctaagcggaggcggaaaaagcgacaggcagagtcgaaaacattacagaa

SEQ ID NO: 65231 - DNA, 1804 bp, Homo sapiens
cggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctgctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttca

SEQ ID NO: 65232 - DNA, 385 bp, Homo sapiens
catggacccttcaatgatatggacactgaaactaaagcaaacagtgaaagattggtatcatagagaaacattcttagagaaatgaaaagccaataacgtcagacaagaaattatgatgtatttccataaagttaaaccaagtgtccttgcctcttctgcctcctcttccaccgcctccacctcttccatctctcccactcctgagatagcaaaccaactcctcttcctactcaacttgaagatggtgaggatgaggatgatgatccacttacacttaatgaagagtcaacatattctatctcccttatgattttattaacaatattttcttttctctagctgtgttattgtaagaaacagtattatataaatatgccgtaaagat

SEQ ID NO: 65233 - DNA, 390 bp, Homo sapiens
ccagctttacctttattcacatttttcctttagaaaagtttgtgttactttttgcctgaagaataatctatgttttattcttccatcaaagcctacctcatcaagtatgttttctgagtactttctagcctgagatatttcactgaattcctaatgtgatatacatttgattatataccatctttttattctattttattacaaaattttagatatccagaagataatgagggcctactgcgatggtgcacgccttgtaatctcagcactttgtggggctgaggtgggaggattgcttgagcccagcagtgggaggtttcagtgagctatgattgtgccactgcactctatcctggatgacaaagtgagaccctgtctcaaagaaacaaa

SEQ ID NO: 65234 - DNA, 472 bp, Homo sapiens
tggtagaggattcattctcttgctttgttgccaaagctggtcttgaactcctggtttcaagtggtcctcccacttctgcctcccaagtgctcagattacaggcatgagccataggacccagccagatacttgattttaatgacttacatgactgaaaaaaaggtaccttcggagattcatagatcctaatggaaaaactgatgctaattgaagaattgctgtactcctactgtttcaattctaaatgatcaattatgcaaagaattttgttgaactcagcaatgacattcctttcattcctgatctcaattagtttttctattatggctaattgacattgcatatatacacacaattaggtttaaaattcagtttttcaagctctttgttcagaagacttagattggttggaatagtcttttcatgtttttaaacattttgtaaactatatagataatgacttaaaaaataa

SEQ ID NO: 65235 - DNA, 609 bp, Homo sapiens
ctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccttgacaccggggtggtgggaaccatgaagacaggatgggggctggcctctggctctcatggggtccaagttttgtgtattcttcaacctcattgacaagaactgaaaccacc

SEQ ID NO: 65236 - DNA, 738 bp, Homo sapiens
ctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacg

SEQ ID NO: 65237 - DNA, 491 bp, Homo sapiens
tcaaaactcactttactcagttaagtgaggaaaggagagggacagtgggaaaagtaagtttgaggttagctggccctagtgattccctcccttttcgttctcttgacctggccctagggcgtcactcttagaagatcatagagattgctttctttagctgttttcttttgtgaggttgagctaaggctcctttgataggaaactagacaaaaaagtaggggcgggccaggcgcggaggctcacacctgtaatcccagcactttgggaggtggaggcaggtggatcacctgaggtcaggagttcgagaccagcccagccaacatggcaaaaccccgtttattgaaaattagcaggggatggtgcatgcgcctgtagtcccagctactttggaggtcaaggctggagaattgcttgaacctgggaagcagaggttgcagtgagcgaagattgcgccagtgcactccagcctaggcgactgagactgtctaaaa

SEQ ID NO: 65238 - DNA, 418 bp, Homo sapiens
tccaggctggttttgaactcctgatctcaaatgatctgcccttcttggcctcccaaagtgctgggattacaggtgtgagccaccgtgcctggcctaaaaaatatttttaaagacaggatctagctatgttgcctcagctggtcttgaactctcagtcttggcctcaagtgatccttctgtctcagccttctgagtagctggaagcacagctgtgagccagcacacctggcttttttttatttctaataaaaaagttaatagagtttcttgtttcactggacaaaatatgcatatataggaaggaaagacttttggacttgagattgcgctgaagaagaaaaatggaaaaattaagcattttagtctctcagtgtgttatttttgtagcttatacagatatgtctttttaaagtgtctt

SEQ ID NO: 65239 - DNA, 445 bp, Homo sapiens
tagggtcactcactgaaagactgaaacctaatcaaaggagcataaaatgcttcccctgtcatgtcattattaaaggtctattcataaaactctttttcccaagtacttcatgtccaagtattaagacaaaattgacagtccatactaaaaagcaaaaaacacaacttaaagagaaagagcaagcattagaaccagatccagacatggcagtgaggtttgaattgttagatagaaaatttaaaactacgataattaagatgttaagggctctaatagatagagtagagagcatgcaagaaaagatggacaaaaaaaaaaagagaaataacagatggacagtgtaagcagagagagagaaattctgagaaagaacccccccaaaaatgctagagataaacccactgtaagagaaattaagaatgccttttacgggcttactggtaga

SEQ ID NO: 65240 - DNA, 4217 bp, Homo sapiens
attcttccacccggcaccggctccgcaatgaacaacttcaggttcactgagctgagcggattccactcgctgtgccctcggagcctgcctgaatctcccgcccagtctcaaaccatgcagctgagtaactgcaagggcgcctttgaggagtagcacgcagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaaaaaagg

SEQ ID NO: 65241 - DNA, 532 bp, Homo sapiens
gtgttgatatagctcaatgttgtatatattattcaggagcagagtttattctaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaa

SEQ ID NO: 65242 - DNA, 4356 bp, Homo sapiens
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgagcttgcaaataggaaggactcaatcagtatttgtgaatgagtgaattaatggataaatataaagagaagggagtgaacagatctgtgggattcttgggcattggaatcaacaggacatgatgattgcttggataacagctgctggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaaaaaagg

SEQ ID NO: 65243 - DNA, 3869 bp, Homo sapiens
aagtggatgcaattgttgaggagaagagtgaaggagaagagaagagagcccgaaactaaacagggaggaatccaccatttagaagtctggcaggcaaagaggacaaggattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaaaaaagg

SEQ ID NO: 65244 - DNA, 3823 bp, Homo sapiens
tcacatccatatttcatcgtccatcaactcccagtcagcccaagatgggcttcggctataagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaaaaaagg

SEQ ID NO: 65245 - DNA, 1251 bp, Homo sapiens
ccattaagtacaaaagtcctgaggttgtaggctggagtttctgaggtcggtgtggctgtagtgaagggaacaatgtggaaagggagatgaggttaggagagaagtggaggctggattgttggagtcttgggcagccactggagagttctgagcagaagtaacatggtctaatttttctattcctgttttgggaacagtctgtggaaaggcaagagtgaaatcagaaaggccagttgagtggctactgaaataattcagataagaagaagcagaggttctgaccatcatggagcagtggtggtggattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaagatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaa

SEQ ID NO: 65246 - DNA, 1147 bp, Homo sapiens
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaa

SEQ ID NO: 65247 - DNA, 1173 bp, Homo sapiens
  misc_feature (1171)..(1171): n is a, c, g, or t
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaaaaaaaaatggccctcgttggcctnca

SEQ ID NO: 65248 - DNA, 405 bp, Homo sapiens
ctgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaatattctccttgtcttcttttattttctttggtttcagatcaatcaaaaaacatgtttttgaacttgaagtcagagaacaatacatgatattaattgatgtgcatccaaa

SEQ ID NO: 65249 - DNA, 4128 bp, Homo sapiens
cagctgcagtgctctaaagatcaaggattttgccttctattttctatgaccagagattcctgtgcaaagagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaaaaaagg

SEQ ID NO: 65250 - DNA, 4213 bp, Homo sapiens
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaaaaaagg

SEQ ID NO: 65251 - DNA, 4377 bp, Homo sapiens
aagtggatgcaattgttgaggagaagagtgaaggagaagagaagagagcccgaaactaaacagggaggaatccaccatttagaagtctggcaggcaaagaggacaagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcaaaacgtagaacaggaagggatcgtctaaattgccccttccaacttccagcacagaagattgctgaaaaataggtggcttctcctgcacttgcaatgatgcgaatatgtctgtggaaaggcaagagtgaaatcagaaaggccagttgagtggctactgaaataattcagataagaagaagcagaggttctgaccatcatggagcagtggtggtggattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagacaataaaacctatgtctttaaggccaaggatgagaagaatgcagaagaatggctccagtgcatcaacgtggcagttgcccaagccaaagaaagggaaagtagagaagtaaccacatatctgtagggatttataagtcagccatgacaattatacaccacaggcattgtattatcattgccaatgtcaagaaaaagagctaaatttaccaagccatgttgttttttactaaataccaatggaattgttgtcctttaagaagaagggcctaaaatggcaggattcttagtaaatgtcatactctaacagctttagtattgacttcagaatatatctgatgcccacaaaaataaaataaaataaaaggagctacagagtatgccctcagatagtgtggggccaggaagggaaaagtcactgataaaagaacttctgtagatatgtcatttaaaactgtgagaaaacaacatgaaaagatgcctgaactctccatcctgaggaaagattagcacttctgatgaaaatcacagtctgtcaaaggtattaaaagaaaactttaaaaaaaaaaacctttagaaacgttgaactaatgtacactgagaaaaaccatataacttacttatagacatataattacatgatcctctcttactacaactgaggctaacacatggtaaaatggttcccaaatcaagccagttatgtcattaaatacttgtctttcagaattacttatttaattattccatttaagttcatataatataatctacagtttagatacttggacatatatcctgcccaaggcactaagtgtaatataggaaaaggatagaaagccattttctctatcttcaaaataatgtgccatctccgttaaaattaagactttaaagttctataattttttctttgtattcaactttttaatacctccaaattacaaacatctatttttttcactacatagatatataattacactatgatagacagaattctagagtgattctcaataatccatgccttggtataatcctctcccccattgagtgtgggtgggacatgtaacctgcttctaaccaacagaatatggcaaaagtgatgggatcatctctcccatattatgttatgttatataacaaaagtgaagagaagttgcagatatacataaggtttctaatcagctgactttgagttaatcaaagagatcccctgggtgggcctgacctaatcagactagtcctttaaaagagagtgaaccagtcagagactctctctcctattagccttaaataagcaagctgccatgagctctacggctgcaaggaaataagttttgtgaacaaccatgtgatcttggaagaagcatctgaacctcagataaaagcccagccccagccaacgccttgcttgcagctttgtgaaactctgagcagaggacccagctaaatcacgtttggactcctgacccacagaaactttcagataataaatgtatgctgttttaaatctaaaaaaagg

SEQ ID NO: 65252 - DNA, 1399 bp, Homo sapiens
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaagatggtgcgaaagttgagcttggggacatgttttgggagatatttaaaagtattttcatcaagcatttatggtttgtgggaagcaagacctagagtattagaagcaaattaatttctctgttttgctgccagttgacctgtgaacatgcaaaaggttacttaatctggctgtctgtgtcccttcccaaggcagatgaattacttagactcattaaaagaattgtaagcattcttccaaatctgtgtttctcagtttgaagaactgcatttccgtgcttctggtcacctgttcaactaccaactgtggagatcttatctctgtgtactgagtggaacacgtcactcagtggggtatgaaaaacctgtcttcatttgcttccaaaagcaagaaatgtcttttgttagataaaatacatcagaaaatgtgtaatgacttcttaaatgtgaacatgatttggataacaagcataaatactagcataaaaagccaaatagtacacctctgttaattgttacaacatttgaatgaataagaagctcaaattagttcatgcaaaa

SEQ ID NO: 65253 - DNA, 2748 bp, Homo sapiens
  misc_feature (2704)..(2704): n is a, c, g, or t
ggttgttaggcaaatctaattctttcaaactacagatctgctcagagaaatctgtaaatctagtgtagaaataagtgaagctttgcgtcaattgttaggtctaagcagaagtttgggagagagaagaaaagttactcatttgcctgattccgcacgagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcaccatgcatcaactgttcagactggttttgggacaaaaagatctttcacgagctggggacctcttctccttagatgactctgagattgaagacagccttacagaagctttggagcaaattaagataattagctcatcttcagattaccaaaccaataacaatgaccaggcagtagttgaaatctgtatcacaagaatcacaacagccatcagagagaccgagtccattgaaaagcatgcaaaggcccttgtggggctctgggactcctgcttggaacataacctgagaccctttgggaaagacgaagacactcctcatgcaaaaatcgcatctgatatcatgagttgcattttacagaattacaaccgacccccagtgatggcattagccatccccattgcagtgaaattcctccacagaggcaacaaggaactgtgcaggaatatgtctaactacctgtctctggctgcaattaccaaggcagatctcctggctgatcacacggaagttatagtaaagagcatactccaaggtaacaccatgttgttgagagtgttacctgctgtgtatgaaaagcagcctcagccaattaatagacacctgacagaactcctggccttgatgtctcagctggaacagccagaacagtaccatctactacggcttttgcatgtagcagcaaagaaaaaacaactcgaggtagttcagaagtgtattcctttcctaattgggcatttgaaggattcaacccataatgacatcatcctaaacatcctcatagagatagcagtctatgagccagtggctttgaacagttttcttccaatgctgaaagagattggtgagagattcccctacctcactggacagatggcaaggatttatggagctgttgggcatgtggatgaagagagagccaggagctgcctgacatacctggtgagccaactggccaacatggagcattcgtttcaccatattctcctgctggagattaaaagcatcaccgacaccttctcctcaatcttgggccctcagagcagagacatcttccgcatgagcaacagcttcaccgccattgctaaactccttacccgacaactggaaaataccaaggctggaagtggcaggagaaaaatcagcactgaaattgaattccctgagaaactggaagaaaccaagctcatagtaactgaaaatgaagaccatgaaaaactccaagttaaaatccaggcttttgaagacaagataaatgcagggagcaatacccctggctctatcagaagatatagtctgggccaagtttctaaagaagaaagaaaaaacattagatttaacaggtcaaaaagtttggctttccacactatgctcacaaagggtgtgggttcagatgacggcgaagatgaaaacaggggagacataccagccagcatctctctttcagaaatagacccacttggccaaggaaatgacaagctgccgtttaagacagacactgagagatcacagctgggggagtcttcagtttcatacccaaatattatacatatagactcagagaatttgtcagaaactgttaaagaaaactcccaggaagaaactccagagacaactgcaagtcctatagaataccaagataagctctacttgcacttaaaaaaaaacctcagcaaagtgaaagcatatgccatggaaattggaaagaagattccagtccctgatcagtgtaccattgaagacactgtgagaagttgtgtagcaaagttgttcttcacctgctccctgaagggtcattactgcctatacagtaagtccagttttattctcatcagccaagaacctcagccatggatccagatcatgtttctatttcagcagagcctgtttcctgaacccctgtccattcagagtcattctgtgcaattcctcagagctctgtgggagaagacccaggcagggggtgctcacagctttgaaactgccatgatggagtccacgtttccacagcagaaggatctggaccaggtacagctccatctggaagaagtgaggttctttgacgtgtttggcttcagtgaaacagcaggagcatggcaatgcttcatgtgcaacaatcctgagaaagcaactgttgtaaatcaagatggccagcctctcatagaaggaaaacttaaagagaagcaagtcagatggaagttcatcaaaaggtggaaaacacgctattttacactggctggaaatcaacttctgtttcaaaaaggaaagtctaaagatgaccctgacgactgcccaatagaactcagcaaagtacagagtgtgaaggctgtggccaagaaacgcagggaccgctctctcccccgggctttcgaaatcttcacagaaggaaaaacccgnttcgcccgagccccccccctcgctttggtgacacgctaaggaaa

SEQ ID NO: 65254 - DNA, 356 bp, Homo sapiens
tagagacagggtctcgctttgtcaccttacagaagaaatatctactcctactgtcactactgctcaggggatgaggtatcccccctgcctaagttgaatcctctgctttctaaatctgtgccccatcctgaccccatcacactagctgtgtaaccctgagtaaattaacgaccctctctgtgtctcatctcctcatctgtaaagtggggatagcaatggttcttgccacagaacgtggttgtgagggctaacaagatgatgcatatgatgcatataaagcacttaacaccattttgggcaaatagtaagtgcctgataaatgtgagctacaattattctagttgtctcatatcccc

SEQ ID NO: 65255 - DNA, 544 bp, Homo sapiens
gcatatatgtggtctgaccaaaaagtcattatgcagcacatgactactcgaagtttaaccgcgtggcatgtaaatatttgaatagaatgttaggacaatgacctcacattatttctgaaaataataaatagcttttcaatatgtaaatacctgaaaagatgggtaattacataatcagatgttaaattagactaaaagttttcaaaagattattcttgagtgtagtcattttttaagtcattatcatctgaaatgatattttattgaccttttatggaggagaaatggaaacatgaagacaaaatgactcaaagcaattattggtatcaggatcagtgattatatccatcacggggaaaaaatttatttaaacaggaaattttcccagaagtctctgttttcttttggaagatatctgcagttcattcggaattagctactgtctataagtccctgaaggattatagcttgtgcagcaagtttaattgcagaattttaaaaaatatatcatgagattcttcaaaatctttttaaatttgtaagt

SEQ ID NO: 65256 - DNA, 360 bp, Homo sapiens
cgtgcaacgcatccactcagggctgttaataattgggttttacggatgcccagattcacaggctatagcttagtgcctctccatcgatttaactatcatttcaggtccatagctcacagctagaaaccaacctacataaaaccccacattaggacgcttcccttcttgtttaggacactgctttccattaggaaaaccaaactacttagcggagagcttgatggatgaggctgacgttataatctcactgaacaattacagggctgtcctattagcgggagacaccccagtacacacataagatttggtagacgagatctgttgaacattgaggggagccgggaagacagagtgcaggtg

SEQ ID NO: 65257 - DNA, 1785 bp, Homo sapiens
  misc_feature (1662)..(1662): n is a, c, g, or t
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggtaccgcccccgccaggcaggagactggcggtggaccaggtggagccgaacntgtaaacaggcattcttggttcgctctgtgaccccagatctccgtccaccgcccgtgcgcacctacggcttcgcacttcctgcacgtcacctctgggactcgccgcggctccttacactctaa

SEQ ID NO: 65258 - DNA, 3838 bp, Homo sapiens
  misc_feature (2185)..(2185): n is a, c, g, or t
cctgaagggaggatgggctaaggcaggcacacagtggcggagaagatgccctcctgggccctcttcatggtcacctcctgcctcctcctggcccctcaaaacctggcccaagtcagcagccaagatgtctccttgctggcatcagactcagagcccctgaagtgtttctcccgaacatttgaggacctcacttgcttctgggatgaggaagaggcagcgcccagtgggacataccagctgctgtatgcctacccgcgggagaagccccgtgcttgccccctgagttcccagagcatgccccactttggaacccgatacgtgtgccagtttccagaccaggaggaagtgcgtctcttctttccgctgcacctctgggtgaagaatgtgttcctaaaccagactcggactcagcgagtcctctttgtggacagtgtaggcctgccggctccccccagtatcatcaaggccatgggtgggagccagccaggggaacttcagatcagctgggaggagccagctccagaaatcagtgatttcctgaggtacgaactccgctatggccccagagatcccaagaactccactggtcccacggtcatacagctgattgccacagaaacctgctgccctgctctgcagaggcctcactcagcctctgctctggaccagtctccatgtgctcagcccacaatgccctggcaagatggaccaaagcagacctccccaagtagagaagcttcagctctgacagcagagggtggaagctgcctcatctcaggactccagcctggcaactcctactggctgcagctgcgcagcgaacctgatgggatctccctcggtggctcctggggatcctggtccctccctgtgactgtggacctgcctggagatgcagtggcacttggactgcaatgctttaccttggacctgaagaatgttacctgtcaatggcagcaacaggaccatgctagctcccaaggcttcttctaccacagcagggcacggtgctgccccagagacaggtaccccatctgggagaactgcgaagaggaagagaaaacaaatccaggactacagaccccacagttctctcgctgccacttcaagtcacgaaatgacagcattattcacatccttgtggaggtgaccacagccccgggtactgttcacagctacctgggctcccctttctggatccaccaggctgtgcgcctccccaccccaaacttgcactggagggagatctccagtgggcatctggaattggagtggcagcacccatcgtcctgggcagcccaagagacctgttatcaactccgatacacaggagaaggccatcaggactggaaggtgctggagccgcctctcggggcccgaggagggaccctggagctgcgcccgcgatctcgctaccgtttacagctgcgcgccaggctcaacggccccacctaccaaggtccctggagctcgtggtcggacccaactagggtggagaccgccaccgagaccgcctggatctccttggtgaccgctctgcatctagtgctgggcctcagcgccgtcctgggcctgctgctgctgaggtggcagtttcctgcacactacaggagactgaggcatgccctgtggccctcacttccagacctgcaccgggtcctaggccagtaccttagggacactgcagccctgagcccgcccaaggccacagtctcagatacctgtgaagaagtggaacccagcctccttgaaatcctccccaagtcctcagagaggactcctttgcccctgtgttcctcccaggcccagatggactaccgaagattgcagccttcttgcctggggaccatgcccctgtctgtgtgcccacccatggctgagtcagggtcctgctgtaccacccacattgccaaccattcctacctaccactaagctattggcagcagccttgaggacaggctcctcactcccagttccctggacagagctaaactctcgagacttctctgtgaacttccctaccctacccccacaacacaagcaccccagacctcacctccatccccctctgtctgccctcacaattaggcttcattgcactgatcttactctactgctgctgacataaaaccaggaccctttctccacaggcaggctcatttcactaagctcctcctttacttnctctctcctctttgatgtcaaacgccttgaaaacaagcctccacttccccacacttcccatttactcttgagactacttcaattagttcccctactacactttgctagtgaactgcccaggcaaagtgcacctcaaatcttctaattccaagatccaataggatctcgttaatcatcagttcctttgatctcgctgtaagatttgtcaaggctgactactcacttctcctttaaattctttcctaccttggtcctgcctctttgagtatattagtaggttttttttatttgtttgagacagggtctcactctgtcacccaggctgcagtgcaatggcgcgatctcagctcactgcaacctccacctccgggttcaagcgattcttgtgcctcggcctccctagtagctgggattacaggcgcacaccaccacacacagctaattttttttttttttttttttttttttttttagacggagccttgcctgttgccagactggagtgcagtggcacgatctcggctcactgcaacctctgcctcccgggttcaagccattctgcctcagcctcccaagtagctgggagtacagcgtctgccaccatgcctaatttttttctatttttaggagagaccggttttcaccacgttggccaggatggtctcgatatctgatctcgtgatccgcctgcctctgcctcccaaagtgctgggattacaggtgtgacccactgcgcacagccccagctaattttcatatttttagtagagacagggttttgccatgttgcccaggctggtcttgaactcctaacctcgggtgatccacccaccttggcctcccaaagtgttaggattacaggcatgagccactgcgcccggctgagtgtactagtagttaagagaataaactagatctagaatcagagctggattcaattcctgtccttcacatttactagctgtgcaaccttgggcacataacttaatgtctttgagccttagttttttcatctgtaaaacagggataataacagcaccccatagagttgtgacgaggattgagataatctaagtaaagcacagtccctaggacatagtaaatgattcatatatccgaactactgttataattattccttcttactctcctcttctagcatttcttccaattattacagtccttcaagattccatttcttaacagtctccaatcccatctattctctgcctttactatatgttgaccattccaaagttcttatctctagctcagacatctactacagcactgtgatgctttatgcaactaactgtttacatatctgtcccctgctactagattgtgagctccttgagggaaaggaacatgatttatttgtccttttcccccagcacctagagtagtgcttggtgcatgatagtaggccttcaataaattttttctaaatgaatgaaatctttctggacaaggttaccttaatcccatgccagctgtcctcatcctctaaaccattcataggcagcagtaaatgtgctcagacagttctgattatggactctcctaacacattctaattctcaaacaaatggttttgttgtcattgttttttctggctccaaatatacccactgtatcagtcagggtcttgga

SEQ ID NO: 65259 - DNA, 402 bp, Homo sapiens
actgaggcgccttctctttttattcttgagccaatgagatatcagtgtgtttattaataaggattgcaatagtatagtgcttaatatgtgccaggcatagtgctaagggtttacatacgttatcccttttaatccagaaaacagcctttgattaggtattgttgtctccattttatagatgaggaaactgaggcagtatgactgaggccgagagcagtggttaagacagactttgggatcaaatcaccctaggtgcgggcaggtttctaggctgctctaagcttctaccttgaaggcagttgggtctgataatagtaccttcttcctggggtggttgtgaggatataacgaggtaatgcatgtaagcatttagtaccatgcctggcacatagtaagcactca

SEQ ID NO: 65260 - DNA, 255 bp, Homo sapiens
ataagagaatcaaggtgctacagcctgggctactgtttttcaaactcattatccaggaaaggagaaaaataaaagaaacccatagttttaatacagtgtgacaagtgctttgataaaccaatcgtaaggtgctgtgcaaggatataagatatacaccaaactcaaccttggggtttcactgaaagcttctaataggccttagccctgatggagtttaaaggattaaattgaattcaacagatttctaaaattaaa

SEQ ID NO: 65261 - DNA, 324 bp, Homo sapiens
gcagaagaatcgcttaaacccgggaggcagaagttgctgtgagccaatattacgccactgcacttcagcttgggtgacagagcaagacgctgtctcaaaaaaaaaaaaaaaaaatctattgaacgctaagagccaggcactggaatatggagatgaataagatactttctttccatagaaacatctgtggcctgtttatatacttaacaaagcatgtgctttacagccatcatttgttaagtcttaacagtttatcttgccaaaataaacagactggtaacatatcacaagaggaatttaggaatagcatcctctgactcaccc

SEQ ID NO: 65262 - DNA, 3890 bp, Homo sapiens
cggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtcgcgagcacgagtggggtggggcgtgccacgggcccccgcccccctcgtccccctcgtcccccagcccagctccggagccgcagtccaggcgcgccgcccgagggtccacgccgcacccctcccccgtgcgttctgcggccacccaggccttccaggacaccgtggagagggaacaagggggcagggacgcccccttcggcaggagccgtcggagaagggggcccagaccggagggaggcgagaagccccactgaagccgggcgcagggtctgggacgcagttgggagtgcaaagggctggctgagagccgcaggagcagcaggctgtggcccaggcctcctgggtgacaggccctgtctggcggggaacagggaccaagagacaacacagaagaggctggacctcgaacaggggcggctgcctcactccctacctgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcctgcaatagtgggggacctggcccctgaggcagtggcggccatgtcacggccaggccacggtgggctgatgcctgtgaatggtctgggcttcccaccgcagaacgtggcccgggtggtggtgtgggagtgtctgaatgagcacagccgctggcggccctacacggccaccgtgtgccaccacattgagaacgtgctgaaggaggacgctcgcggttccgtggtcctggggcaggtggacgcccagcttgtgccctacatcatcgacctgcagtccatgcaccagtttcgccaggacacaggcaccatgcggcccgtgcggcgcaacttctacgacccgtcgtcggcgccgggcaagggcatcgtgtgggagtgggagaacgacggcggcgcatggacggcctacgatatggacatctgcatcaccatccagaacgcctacgagaagcagcacccgtggctcgacctctcatcgctaggcttctgctacctcatctacttcaacagcatgtcgcagatgaaccgccagacgcgccggcgccgccgcctgcgccgccgcctggacctcgcctacccgctcaccgtgggctccatccctaagtcgcagtcgtggcccgtgggcgccagctcgggccagccctgctcctgccagcagtgcctgctggtcaacagcacgcgcgccgcctccaacgccatcctggcctcgcagcgccgcaaggtgccccccgcgcccccgctgccgccgccgccgccacctggagggcctccaggcgcgcttgccgtgcgccccagcgccaccttcacaggcgccgcgctctgggcagcgcccgccgccggccccgccgagcccgcgccgcctcccggggcgcccccacggagcccgggcgcccccggcggagcgcgcaccccggggcagaacaacctcaaccggcccgggccccagcgcaccaccagcgtgagcgcgcgcgcctccatcccgccgggggtccccgcactcccggtgaagaacttgaatggtactgggccggtccatccggccctggcagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtaagaatcccgaggatgtggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaaaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctc

SEQ ID NO: 65263 - DNA, 1811 bp, Homo sapiens
cacggcccttccgcaggctcctccccagccctgaacctgggctaccaggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaaaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctc

SEQ ID NO: 65264 - DNA, 1518 bp, Homo sapiens
aacatttttaacttggaaagagcttttactggaagttcaggaaatacaaatgcaaaggaaatggccaagccagcagtacgtagttggtgctaatggacgaagccataaggtagccatgatgtggcaggggagggagggaggctgaggctggtgggctggaagctgcctgtgacctcctcccggccccactgtgtccctgtccccccaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaaaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctc

SEQ ID NO: 65265 - DNA, 2789 bp, Homo sapiens
cggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtcgcgagcacgagtggggtggggcgtgccacgggcccccgcccccctcgtccccctcgtcccccagcccagctccggagccgcagtccaggcgcgccgcccgagggtccacgccgcacccctcccccgtgcgttctgcggccacccaggccttccaggacaccgtggagagggaacaagggggcagggacgcccccttcggcaggagccgtcggagaagggggcccagaccggagggaggcgagaagccccactgaagccgggcgcagggtctgggacgcagttgggagtgcaaagggctggctgagagccgcaggagcagcaggctgtggcccaggcctcctgggtgacaggccctgtctggcggggaacagggaccaagagacaacacagaagaggctggacctcgaacaggggcggctgcctcactccctacctgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcctgcaatagtgggggacctggcccctgaggcagtggcggccatgtcacggccaggccacggtgggctgatgcctgtgaatggtctgggcttcccaccgcagaacgtggcccgggtggtggtgtgggagtgtctgaatgagcacagccgctggcggccctacacggccaccgtgtgccaccacattgagaacgtgctgaaggaggacgctcgcggttccgtggtcctggggcaggtggacgcccagcttgtgccctacatcatcgacctgcagtccatgcaccagtttcgccaggacacaggcaccatgcggcccgtgcggcgcaacttctacgacccgtcgtcggcgccgggcaagggcatcgtgtgggagtgggagaacgacggcggcgcatggacggcctacgatatggacatctgcatcaccatccagaacgcctacgagaagcagcacccgtggctcgacctctcatcgctaggcttctgctacctcatctacttcaacagcatgtcgcagatgaaccgccagacgcgccggcgccgccgcctgcgccgccgcctggacctcgcctacccgctcaccgtgggctccatccctaagtcgcagtcgtggcccgtgggcgccagctcgggccagccctgctcctgccagcagtgcctgctggtcaacagcacgcgcgccgcctccaacgccatcctggcctcgcagcgccgcaaggtgccccccgcgcccccgctgccgccgccgccgccacctggagggcctccaggcgcgcttgccgtgcgccccagcgccaccttcacaggcgccgcgctctgggcagcgcccgccgccggccccgccgagcccgcgccgcctcccggggcgcccccacggagcccgggcgcccccggcggagcgcgcaccccggggcagaacaacctcaaccggcccgggccccagcgcaccaccagcgtgagcgcgcgcgcctccatcccgccgggggtccccgcactcccggtgaagaacttgaatggtactgggccggtccatccggccctggcagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtaagaatcccgaggatgtggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgggtgcccagccgtgagggcatgggagataggcacaggcaggggctccagcaaccactggcctgggcctgtggtccccatcattcccaatccctgctctcacattcctcccaaaagcagcacccaaacagtaacgaccacagccacctccttcacacatcttatctcgtttcctgagccactgaggtcaagatcctgaccccatttt

SEQ ID NO: 65266 - DNA, 3653 bp, Homo sapiens
cggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtcgcgagcacgagtggggtggggcgtgccacgggcccccgcccccctcgtccccctcgtcccccagcccagctccggagccgcagtccaggcgcgccgcccgagggtccacgccgcacccctcccccgtgcgttctgcggccacccaggccttccaggacaccgtggagagggaacaagggggcagggacgcccccttcggcaggagccgtcggagaagggggcccagaccggagggaggcgagaagccccactgaagccgggcgcagggtctgggacgcagttgggagtgcaaagggctggctgagagccgcaggagcagcaggctgtggcccaggcctcctgggtgacaggccctgtctggcggggaacagggaccaagagacaacacagaagaggctggacctcgaacaggggcggctgcctcactccctacctgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcctgcaatagtgggggacctggcccctgaggcagtggcggccatgtcacggccaggccacggtgggctgatgcctgtgaatggtctgggcttcccaccgcagaacgtggcccgggtggtggtgtgggagtgtctgaatgagcacagccgctggcggccctacacggccaccgtgtgccaccacattgagaacgtgctgaaggaggacgctcgcggttccgtggtcctggggcaggtggacgcccagcttgtgccctacatcatcgacctgcagtccatgcaccagtttcgccaggacacaggcaccatgcggcccgtgcggcgcaacttctacgacccgtcgtcggcgccgggcaagggcatcgtgtgggagtgggagaacgacggcggcgcatggacggcctacgatatggacatctgcatcaccatccagaacgcctacgagaagcagcacccgtggctcgacctctcatcgctaggcttctgctacctcatctacttcaacagcatgtcgcagatgaaccgccagacgcgccggcgccgccgcctgcgccgccgcctggacctcgcctacccgctcaccgtgggctccatccctaagtcgcagtcgtggcccgtgggcgccagctcgggccagccctgctcctgccagcagtgcctgctggtcaacagcacgcgcgccgcctccaacgccatcctggcctcgcagcgccgcaaggtgccccccgcgcccccgctgccgccgccgccgccacctggagggcctccaggcgcgcttgccgtgcgccccagcgccaccttcacaggcgccgcgctctgggcagcgcccgccgccggccccgccgagcccgcgccgcctcccggggcgcccccacggagcccgggcgcccccggcggagcgcgcaccccggggcagaacaacctcaaccggcccgggccccagcgcaccaccagcgtgagcgcgcgcgcctccatcccgccgggggtccccgcactcccggtgaagaacttgaatggtactgggccggtccatccggccctggcagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtaagaatcccgaggatgtggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaaaatggccagcacgagcggggactagagggtcctgattttgtgtctgtgcctcttcatctctctggactctgatctccttctcccttccattcgggcttctgttggccaattaagggtgttccattcttcctaaccattctttcaccaatggtccatttggaaccagggggtctgattcgacgaagggagcatggcgggataagcagggggagaaacctctgggggggggggagttgcccaccg

SEQ ID NO: 65267 - DNA, 2068 bp, Homo sapiens
ggcagtgacttcctggagcactgtgttgaggaggactctgaagttgcatcttggcttagcgggtccccgcactcccggtgaagaacttgaatggtactgggccggtccatccggccctggcagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtaagaatcccgaggatgtggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaaaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctc

SEQ ID NO: 65268 - DNA, 423 bp, Homo sapiens
cagacctcaggactccccaggcaagagccataacaccccttggggttctgcagttgctggcatctcctagttttggggcactgctgcatcctcctcatccagacgccagcatccaaggtgaaagatggtcacagcatgcccaggccagccgcaggctgagcacagaaccatggcaggtgcagaatcccagccagtggcacaagctgagtgcagccagccaggctgagtgggtggagcaagcccagcagtgagccaggagccaagcaaggcccaggcaggggcaccactctctgagagagacccggagcaatcttcaaggaaattcaaaagggaaacaattggtagattggtaaggtgacaaggaaaaagaaaggatgaagggagagaggtaaggaacaatctgcatagcacagagaagacctg

SEQ ID NO: 65269 - DNA, 363 bp, Homo sapiens
gccatggtctctaataactgcaggcacatatctttctggatggaaaagactctcttattccaggtttaggaataaaattctcagggaataattttgatgggctcatcttaagccagtttttatctattaaacaagcatggtggttacagatataatgtaagcaaagcacagttaacattagatctgtgtggtatggagaatgttccaggttggatgactggagagatggtgataccaccaacttaggcagaaacacaggaggactgagctagtatgggaggaaggacatggagagttcaattttggatattctgagttagaactataactaggacattcaggtggatgaatctcagggcagtt

SEQ ID NO: 65270 - DNA, 1243 bp, Homo sapiens
  misc_feature (1)..(1): n is a, c, g, or t
  misc_feature (9)..(9): n is a, c, g, or t
  misc_feature (11)..(15): n is a, c, g, or t
  misc_feature (17)..(17): n is a, c, g, or t
  misc_feature (395)..(395): n is a, c, g, or t
  misc_feature (930)..(930): n is a, c, g, or t
  misc_feature (1224)..(1224): n is a, c, g, or t
ngatccacncnnnnngngtggattcctgccctgttcccacaggacagccctcaaccaatggagacaggaacctggagttaaatgcttctccctttttcactgagagagagacatgcacagtctgatgcactttctttccttctttctttttctttctttttttttcttaagacagagtctctctctgtcaccaaggctggagtgcaggggcacgatctgggctcactgccacctccacctcccgggttcaagcaattctcccacctcagcctcccgagtagctgggattacaggcactagttaccacgcccagctaatttttgtatttttagtagagatgcggtttcaccatattggtcaggctggtctcagactcctgatctcaggtaatctgnctgcctcagcctcccaaggtgctggaattacaggcatgagccaccacacctggccgtgatgcactttctagatgctgtcctagagatcacactgtgttaagcctcagttgccttcaatgtggtcatctctacagtatacccttagcttttttctcctccgttactttcccagaccctcactctgctccctggattcacttttcgaaatagtcctcctgctgcaaagtcctgggcacctgccctactttcagcattggaaggggggcccaggctaagaccatgaggccccactgtgggcgcccacagccccgttcctccctctattcccaccacagtcacatcctcctgtccctcagtgcttcctcgcctttccctccagcccaccgtgagatcccaggggacggagcagccccttctctgccccagtgcagggcttggccttagcacacggtcagtctgtgctggggtgaagtgatgaatgagtgagtggttgagtgataatgcatcatcagatctgtcttttccacatgtctcnatctccacccagaaccagttttctcatccacaaatgggcatttgaggctgggtgctcctaaaccctacaaaattcagagctggcacagttggggactgaccttccttgatctcacctcactttctgtatctataaaatggggtacctttctctaagagtaaaaaggaggcctggcatagggaaagaaactcagctcgagcatccagaacatccatcttgctctcaaatacctaatacaggggaccatgttttctgctataattggtattggagctggtaccatttattaaaggnaattcagttacaaagcttc

SEQ ID NO: 65271 - DNA, 474 bp, Homo sapiens
gatatttttatcataagccctatcaaaactctggctatcttccggagatcaggaaacaaccacacacttccatctattttaaacgtggaagaattagaacgtggcacagcagaccctaaaaatgatggaaaaggctgtgaaggtgacacactaatcgctaaccgagaaatgcctgattgaaaagtataatcgtgtgtcccatacggaagtatattgtgtcctcggaccccaagcggcgtgcccggaggctcaatgtcaccttcgccgaggcgctgcaggccggcggcggccactctcggtcaggtggccgcagggtcggcgctggggcagggtcatggcccgggaaccgaaggggagcgctgcgtcccctcctcggcgcccacagcaggtccacatctgacctgtccgcggtggcacagccaggaagttgcgcggggggaggccccgggggcgcgctttcaggtcctccactac

SEQ ID NO: 65272 - DNA, 293 bp, Homo sapiens
gattcagagctaaaacatttggggttcttcaaagaagagaggcatttatcaagaggaagctgcctctaagcatgagttgaaagcagttgtatatcagactttatggagagtagtggtatttagttgccgttttgtaagctgttcttatatggtactaattttgttttgttttgttttttgtttttgtgaggttttggtttcgttttgttttggtagagatgccagggactgaatatggtactaatttgtgactcatacttaagagtagttaaatttttgcatgctaattttcc

SEQ ID NO: 65273 - DNA, 607 bp, Homo sapiens
taaccaaaatttgctgtgctagagctagactttggtctgaattggcagaggtagaacccatgttgcatgtttatcctaaatctgtaggaatttcccaaaccttgtttttcaaagttgagaagtagaaagtaataaattcaatcagggcccagacatgttttgtaccccctttaccctttggtctttcttccttttatcctattccactgagcttgttctttggggattgtggtgcctgacatcactgtctttcctcccctaggacactgacttgagtggagagacctcggcaattcaaggctgtcctgcagctctctgttgcctcagcaatgtcaggacgactgtctctttcctaagtaacataattttaaagaacaatttgttcctcagggaataatgtcttggattgtggggaatcctattaaaagtacaactattgcagtcatttgcttttacttttaccagcctcactcataaaccctccatctgtttgttgctttaaatagaagcacattataagagattatcacttgatcaggctgcatgtctgagtgttgtgtgttttcacatactcatgtatactaaggaataaaagaaagcaaaccac

SEQ ID NO: 65274 - DNA, 658 bp, Homo sapiens
cttagatcttaagccactgctgatcttcttagaaccacacaccgcaggtgcttccctgtggaaactgcaaatgtttactctgtcttccacctttgaatgacttagaacatgttgtggctaaggttcattcgttatcaacattcagaaactgccatttccttttctacctgcaaagcctaataataactttttaaactattgcttcctttgcatattcaccatacatcctgctttcagatgtggaatctaaaaccttgctgagaaactgcctccaatgttgctcccttaactttcactgtggaaaactctgaaggaagttggccgcaccatttaatggaagcatgaggaactagtctctttcctttagatatgtatgaaaatggctccactgtgactcagcagatggctccactgtgactcagcagatctccaggattttcctgtgtagtttctgttttggctttcatctggtgggaactgactgctacaggaccgaggcttttaaatcaaacccaaataacaaaatgtatttagagctgaaaaaggtggtgccatcaggctggggtggggatgaggaagtgattcattaccccagttggaatgtaaattcaatgagtttaattactagtggtgtcaaaaaaggattttcactgatagc

SEQ ID NO: 65275 - DNA, 267 bp, Homo sapiens
gcaggggaggggagaattaagacagcttctataaattaaaaaccaagaagctttccaacaatctaagacaagattctagaaggagtggaatatagagttctgtaggctagactgaggtgtcttgctaaaatctgacaatggcagtcttttttcaaccatggagaaaagtaagttaatcgataaaacaatttaaatgtcaagcttttccctcaaacttttcttaatcagcatctgccaccactagcctattcttgaatttagtttaag

SEQ ID NO: 65276 - DNA, 497 bp, Homo sapiens
gagttgtgcaactgtaaaaggccttgtgtgctgtgtttggacaaaggcaatgacaaccggaatggagaggaagccttattttagaggtccatacctggaagaactgacaacataaccagttgaatgtgggaaatctgcaacagcaaagcaagcatctaggataactctaagagccagcttgggcaaccgagtggatggtagtgccactgagtgtgacagggatggcaagaaaagcattaagttccaaggggaaagaaaactaggacatgtccaggttggggtatctatatactatctaaatggagcaatccactaggcaagtgagaatttgagattagagttcaaggttatgatcaaggctaaaggcattgatcttagagatgacaataaaaacaccaagagaggtgatggtaaaagccttaggactgaatggcgtcgcccagctctcatgtgtaaagtggaaggcagaggagctactcttggtaagagcaacattg

SEQ ID NO: 65277 - DNA, 507 bp, Homo sapiens
tcaaattggagagaataactgtcaaatgcagagaatagtggcttgtctgagcaataacccatgagcataaaccaccttgagaaccagtgctgaggtagggaaacgtgaactgtgagaaattactagaggctcagcatggacaggtttgagacataaaaacctccagggggacccaatcactgagtacccccatacgtttgtaagttttatctccaaaagttctaccaggttcacgggccgggcgcgttggctcaagcctgtaatcccagcactttgggaggccaaggcaggtggatcatctgaggtcaggagttcgagatcagcctggccaacatggtgaaaccccatctctactaaaaatacaaaaattagccaggcacgttggcatgcacctgtaataccagctactagggaggctgtgacaggagaatcacttgaacacaggaggcggaggttgcagtgagccgagattgtgccactacactccagcctgggcaacagagcaag

SEQ ID NO: 65278 - DNA, 516 bp, Homo sapiens
gtgaaagtgggcatgagggcagcagaaggagtaaagcatgagggaggaggtctcctctggcacctgagctgaagggccctcagggcagccccaaggccgcagcctcccggttgccctgcagcctggctgctgagtcccagctgcttcagctggctagaggtccttacttagttgtctcaagcacctgaagcctaccttgcccacctgcgagtcactcgccccacaagcagggcacccatctgagtcctgtgcccagggcaaaccccacaactgcctggtagtggagccacgacagggcagtcagtgctcaggaggtgccacacagcccccaagcacagatgcggccacacaaagccgctattatagttaacaggttgagccagattctctgtgtgccacccaccgcactgcacagggcctctaggaccccatccctgcctgggttcctggggcccctcaggccgccacccactcaaccagagggccagatctgaggggcagggctcgctggccgca

SEQ ID NO: 65279 - DNA, 2352 bp, Homo sapiens
  misc_feature (1)..(2): n is a, c, g, or t
  misc_feature (2138)..(2138): n is a, c, g, or t
nngaggtttgggagcctctgcctagatttcagaggatgtatggaaactcctggatgtccaggcagaggtgtgctgcagatgcacagccctcatggagaacctctgatgggggagtggagaagggaaatctgaggttggagcccttacacagagtctgcactggggcatggcctagtggagttgtgaaaaaagggttgccatctttcagatcccagactggtaggtccattgacagcttgcaccacatgcctggaaaagctgctaacactcaatgccagcctgtgaaagcagccaggaagagggctgtaccctgcaaaacaacaggactggagctgccccaggccttgggagcccactcttgcatcagtgtactaggatgtgagatatggagtcgaaggagatcattttggaactttaaggtttaataattgccctattggatttcaaacttgcatggggcctgtagccccatttttggacaatttctcccatttgtgatgggtttatttacccaattcctctacccccgttgtatctaggcagtaattaacttggttttgattttacaggctcataggcagaagggacttgccctgtctcagatgaggcttggaacttggagttttgagttagtgttggaatgagttaagaatttgggggaccgttggaaaggcatgattgtgttttaaaaagtgagtacatgagatatgggaggggtcagggacagaacgatatggtttgactgtgttaccacccaaatctcatctggaattttagttcccataatccgcacctgtcatgggagggacctagtgggaggtaattaaatcatgggtgcagttacccccatgctgctgttctcatgataatgagtgagtcctcacaagatctggtggttttataagggacttttcccctctttgctgccgtgtgaagaaggatgtgtttacttccttttccaccatgattgtaaatttcctgaggcctcccaagccatgcagaactgtgagtcaattaaacttctttcttttataaattacccaggatcaggcacttctttatagcaacgtgaaaatggactactatataaaccctaccattaaaactcttcccttggagagtcactgttcacctcagcctattcatgacactgataatgtttgcaataaaaatctgtttaactttttttgacatgtgtcctccaaacatcttgaccttggaactccttaccttccacagatagctccctaagtatatgtacatacataaacacacatacatgtagcacccattaaccagaattctgggcaaataattctcacttgcattttcctaaagctggtttttcttgattacttgagaagcatatattatagtagctagagctcatggcctagcagagtgaccttcagcaagttttaaaatagtgactatcttaaaaagttgttgcaaaagttcaatataacaaaagagctagaaacaacatcagtttccttgtaagcaggtaatgaaaattaattattgttaattcgtatgtagactatatttttggaagtcctaaattattcttgttagtcacattgtttatttttttcctacatagtcaattttaaatatttctctttttaaagcttctgccaaaatgatgtttcttatcagtgttaagtctaggatttattttttgtcagcaaggtaaccaatgcagtgaccttctgcaaaccagccatagatacatcttgctctgactccagctgagctaagctgggcctagagcagtaggacccagctcctgcagtggcacctaagttcctctttactaaacttgcatgcttttgggaaaataaaggaggggatatctaaagctctggacaaccttgagaagctcaatttttgctgccctgaagaaagtgtaaggatagatatttaatggagctgctgctgctgggtctgttgctcttgtaagtccttcctctggggaagtgaagggtacaacaatatcggatgtcagattttaaaggaagggaatatcttcatctctcctgaaccactaattgagattatccattgcttgctgccaaaagaaagacataaatagaaacaaaactgaaagtagacaataaagcaaacaaaaatctgcnaacaatgaaactaaatcaaatcttcccagtgtaaactctgggcttaacatgcctcctgttgtgttttgatatttttggtgtcataaaaaagtaaacaggatattttatttccagggccttataaagccagatggtaggggccttatctattctttggataattctggtatcctccattggcttaagccagatttagactcacctcatactaggt

SEQ ID NO: 65280 - DNA, 285 bp, Homo sapiens
tttttccactccaaacttcagcactgttacatggctttgacccacaaaacactgattgctttggaggggtcatctgatcttatgagtcaataacattcttccttggatttttgaactttggtccaaaaagaataatagatgcatcttttttccagatgatagtcataagatataaaatgttggcactttcagttgtcatgttttctactatgtgcaggaagccaattgttggtaagagaggagtatttagtagaagaaggtaagtcaatccctgataaattataa

SEQ ID NO: 65281 - DNA, 4804 bp, Homo sapiens
  misc_feature (641)..(641): n is a, c, g, or t
  misc_feature (655)..(655): n is a, c, g, or t
  misc_feature (1549)..(1549): n is a, c, g, or t
gtggagtgcccctgaaaggtcatactcctccattttgtcttttaatgttgatgccccgggagttacttcttcctggtatcttccttcaattaacactttaacgtgacagctgtggaccatcaggagattgtcgctccctggcagtgacagccaaattatcatttttagagaggcaacgcgataactgtcaaatcatcctccaataatcaccttagggtcctggtgggttggggagagagccctctcctcccctactcatggcctgtctaactctctgcaacaagttgctttattgcaatatttgttttattgtgttggtctggaactgaacctgcagtatctttgagggttgcctgcattaaagaatttctatgataaaggaaatcaaacttaaaaagttacgtgaatggtttaagaaagcaaacttcagaagagcccatgacctttaatagaaatatctatgttcgtttatttaaaaactattcatagttgcttaaggtgatatctcttgatgtgatagctctatttttcttataatatggcagttgaatcccaaagaaaaaacagtttcacaggacaatacctcaagtaagatctcttattttctcctgtgacgctctctaatgtcccattgaccaaanccagtcatatgaanaggctcactgtgaaagtgtgacaggactgccccaagcatgaaatctgggagacatggatcatggtgagcatcaaaataacatcaatatgaaaatatttctacaattttggtgggaaagtgtaagaaaaagatatttattatttattcgtggatgaacattcaagagtagtaagaaacaaagtgcttccttccattataacgcaaaataagcatttaataagtacatttaaaatgttactaatatggagtaaagattatgctagagccgtatgtctaaaaataatatttttaaaatgtgtaagtgtagtttttaaacatatgaggtttcttctcagcaagcagactaagtagctttattgagaatcttactgggaaaacaagagaaaaatatcaaaaatgtacaattaaacattttgaaaaaaatgttcttaatggaattgattaaatactgatatagttagaaatatttaaataccaaaactaagtgaaaataaaaattctatatctggctttttcgttaagaatatttgcaaatagggtaaatttgagtttcaattaccttgaccttgaggcacacaggggcagttggtaaaagcccgtgtcagccaatttgaggcaaactacaaaggtagaagccaaaatttcttccccttgagttattaaatccaaactcaaaaaatcacatacacacacacacacacacacacacacacatacacacacacaaatgcaacaaaacctctggactgtgagaaatgtatttctgctcattaaaaattagtctcaggttttctgttatagcagcattttggtaataactaataataaaacaatacactcttgagaattcatagctatgtgatataagtattatttataagaactagtttacanctaagatgtaattcactgtgaaatcagaaaaaagtattaatgcctaattattgggagttatgactgcatattgtaacaattttgaactgcttgagttcagtaaaagaagtcttcatggaagtaaagtaactaacatcaaattagagaaaataattcagaagcaaaacaataacaagtaacagtgaaccttcagtacacttctctgcattaaaaattatttgtatattttaaagacataatttagaacttcctgacactgctgtaaaacatagtctactgatcagaaatataagttttccacacataatgcttatcttacttgaagaaaaatgtttcaagcaaagatgtcttttataacaaaagacagccacctaagaaaaagtagaacacttctgtggtttgaatatgatcttcaaaaagcatgtgctggagacttaattcctaatacagcagtgttgggaggtagatcctaatgaagggtgattagactgtgagggcagagtgaatgaatcaatgtcattattgcaggggtaggttagttataagacgggaagttctgcaatctctctctctctctctgtctcctcttcccctctctttccctctctttgccctttcatgatctgatacctccaatgtgttatgaggcagcaataaattattcaccagatgccagcccctcaattctggaattcccagtctccaggactgtgagaaatggatttctgctcattataaattgctcagtctcaggttttctgttatagcagcataaaatggactaaaacagacactatcttgatttatagctctttgcaattatgtttaattattttggaaattttgttgcattcactggtttaccctagtgtattagtccattctcacaatgctatgaaacattgaactgcctgtgactccgtaatttataaagaaaagaggttaaattgaatcacagttctgtagggctggggaggcctcaggaaacttacaatcatggcagaaggggaagcaaacatgttatttttcacatggcagcaggaaggagaaatgccaaacaaagagggaaaagtcccttataaaaccatcagatctcctgagaactcactcactatcataataacagcagcatgggagtaactgccccagtgattcaattatcttccactgagtccctcccaggacacgtgggaattacgggaacctcagttcaagatgagatttcagttaggacacagtgaaaccataccattctgcccctggcccctcctaaatctcatgtcctcacatttcaaaacacaatcatgccttcccaagagtctcccaaagtcttaattcatttcagcattaactaaaaagttcatagtccaaagtccattctgagacaaggcaagtcccttctgccaatgagcctgtaaaattgaaagcaagttaattatttcctagatacaatagggatacaggcattgggtaaatacagccatttcaaatgggagtgattggtcaaaacaaaggggctacaagccccatgcaaatctgacatccagcaggcattcaaatcttaaagctccaaaatgacctcctttgactctatgtctcatatcctgctcacattgatgcaagaggtgggctcccatggccttggacagctccacctctgtggctttgcagggtacaacccccttcctggccgctttcacagactggcattgagtgtgtgctgattttccgggtgtacagtgcaagccatcggtggatctcccatgctggggtctgaaggatggtgaccctcttatcacagctccgctaggcagtgccccagtgaggagtctgtgtggggactctgaccctacattttccttctgcactgccctagcagagattctgtttctgtttatcctactctgtgtgggccaggcccagggctccctgctctatgcagcttagagatattgtgccctgcatcccagctgcttcagctccagccatggctaaaaggggccaatgtacagctcaggccgttgcttcaaaggatgcaagcctcaagccttggtggcttacatgtggggttagacctgtgggtgcacagaagacaagaattgaggtttgggaacctccacctagatttcagaggatctatggaaattcctggatatcaagccagaaattagctgcaggggcagaaacctcatgaagaatataaggttatttttatttatctttttatgtgatccatattttttctctctctctctctctgtctgtactttcctccttcattctctcaaattgcaggttattctttttctctccagtgtgctaaactttctttacttcctgccctagaaaaagtctatattcttgcccaggtttagggcctcagtggaccctgaattaggaaatgttctttagtcctgacctattttcatgatctcattaagggttttctacactgttttctttttggaaacaatgtataggtttatgcgtaatctgttcataggaatggtgcattaaggaggggcctcactgacagtctcttcagtatttcattttgggctggtcagtttctctgggaactattcccgaaaggtctttgtttgatagtagaggacagggtgaaaataaagatgggcattggctttcagtttgcatgcataatgaagatttctgcttttggcctgttacctctgcctacaaaagtgtctgaattcccctcattaataagtcctattctttatcatctccagagaacaaattggcattcttctctctgtttgagggactgttagacatgtggctgaatgcagtggaggaagaaactcaggatgctgctcattcttgaataggttttaagtgactatcctaattttgtgacccctgggttatcactactttcagaggtatcagacgcttttaattcatgaatcttgacaataatgcaagtttgttgaacaatttttgctgaagcaccccccaaaaccaaaaacaaatatttaactacatggatattgggagtaccaacaaactcatataatgtagaagaccatagaataatttgtacaaattgaaagatgatacgggaacttgacaatgacattgcctttaatgttaaacatgatgcagaattcaaaaaagattatggaaaggttgtattaatttcagcagagatggaaggatttggacatattgtttggtactgtcatatgagatacaaaatcagaagagggaaaataataaagaccaatgaaattt

SEQ ID NO: 65282 - DNA, 367 bp, Homo sapiens
tttttttaatgagcagtttaatggaaaataattgctccaggtacaggtcttctaggcacattttgtctctgcagctattgttttaattagtgggcctgcttgttcgctgtccctttgttgtggcccgctctggggcaggggtgcccggggagggttcctcttgtggaacgcaggcgttaatgagccatttcagtaataagagtcctgccttgagccagaagtcagagcacccaagacaccccaagcagcagaaatgctcatgaatttctgaaactgcctttctaatttgcatttaaacataacttccaaagaacaatttcacctgtgattttctgaggtcgacaggtaagggactttagatgttgaa

SEQ ID NO: 65283 - DNA, 1704 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaaca

SEQ ID NO: 65284 - DNA, 545 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgac

SEQ ID NO: 65285 - DNA, 530 bp, Homo sapiens
  misc_feature (447)..(447): n is a, c, g, or t
gagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactncttcttgcagtgagccgagatcgcgccactgcactccagcctgggcgacagagcgagactccgtctcaaaaaaaaaaaaaaaa

SEQ ID NO: 65286 - DNA, 2639 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctgccagcacctgaaagcttcctcgacatctgttaataaagccgtaggcccttgtctaagcgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctac

SEQ ID NO: 65287 - DNA, 1733 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacaaaacacaaacaaaaaagacaaaacaacaa

SEQ ID NO: 65288 - DNA, 1163 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagactctgtctccattctctcatcacacacaagtcatgcatctaccaa

SEQ ID NO: 65289 - DNA, 1773 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaaca

SEQ ID NO: 65290 - DNA, 1246 bp, Homo sapiens
  misc_feature (32)..(32): n is a, c, g, or t
aacttaggctaggtacgaggcctgggtggtgnaaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaaca

SEQ ID NO: 65291 - DNA, 1209 bp, Homo sapiens
  misc_feature (32)..(32): n is a, c, g, or t
aacttaggctaggtacgaggcctgggtggtgnagtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaaca

SEQ ID NO: 65292 - DNA, 1045 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagactctgtctccattctctcatcacacacaagtcatgcatctaccaa

SEQ ID NO: 65293 - DNA, 1586 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaaca

SEQ ID NO: 65294 - DNA, 2353 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctgccagcacctgaaagcttcctcgacatctgttaataaagccgtaggcccttgtctaagcgca

SEQ ID NO: 65295 - DNA, 1219 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcaca

SEQ ID NO: 65296 - DNA, 1905 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgctggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctgccagcacctgaaagcttcctcgacatctgttaataaagccgtaggcccttgtctaagcgca

SEQ ID NO: 65297 - DNA, 1678 bp, Homo sapiens
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccatgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgtgtgttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaaca

SEQ ID NO: 65298 - DNA, 2276 bp, Homo sapiens
ctccagccattggtgtctgtgtcattactaatagagtcttgtaaacactcgttaatcacggaagccgccggcctggggctccgcacgccagcctgtggcgggtcttccccgcctctgcagcctagtgggaaggaggtgggaggaaagaaggaagaaagggagggagggaggaggcaggccagagggagggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgtctggctctgtccctggggttctggggccaactgggggggtgctaaaccccaccgtcacccagtgacccaccggggtctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctacacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaacccccaggtggcctgcgtcttttttctcttcccttcccagaccaggaaaggcttggctggtgtatgcacagggtgtggtatgagggggtggttattggactccaggcctgaccagggggcccgaacagggacttgtttagagagcctgtcaccagagcttctctgggctgaatgtatgtcagtgctataaatgccagagccaacctggacttcctgtcattttcacaatcttggggctgatgaagaagggggtggggggagtttgtgttgttgttgctgctgtttgggttgttggtctgtgtaacatccaagccagagtttttaaagccttctggatccatggggggagaagtgatatggtgaagggaagtggggagtatttgaacacagttgaattttttctaaaaagaaaaagagataaatgagctttccag

SEQ ID NO: 65299 - DNA, 251 bp, Homo sapiens
aaagttgctttgaaaagaaactcagggagcaaggaaggaggaagactcttccccatgaggctgaattgggcctaagaatggatccagggttgggctgttatggggttgttggtctgtgtaacatccaagccagagtttttaaagccttctggatccatggggggagaagtgatatggtgaagggaagtggggagtatttgaacacagttgaattttttctaaaaagaaaaagagataaatgagctttccag

SEQ ID NO: 65300 - DNA, 2247 bp, Homo sapiens
ctccagccattggtgtctgtgtcattactaatagagtcttgtaaacactcgttaatcacggaagccgccggcctggggctccgcacgccagcctgtggcgggtcttccccgcctctgcagcctagtgggaaggaggtgggaggaaagaaggaagaaagggagggagggaggaggcaggccagagggagggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgtctggctctgtccctggggttctggggccaactgggggggtgctaaaccccaccgtcacccagtgacccaccggggtctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctacacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaaccccctgaccagggggcccgaacagggacttgtttagagagcctgtcaccagagcttctctgggctgaatgtatgtcagtgctataaatgccagagccaacctggacttcctgtcattttcacaatcttggggctgatgaagaagggggtggggggagtttgtgttgttgttgctgctgtttgggttgttggtctgtgtaacatccaagccagagtttttaaagccttctggatccatggggggagaagtgatatggtgaagggaagtggggagtatttgaacacagttgaattttttctaaaaagaaaaagagataaatgagctttccagatttcagattctgtatttatcttcagattttgtctgcaactattttttattttttaaagaaatgaaatatcttc

SEQ ID NO: 65301 - DNA, 506 bp, Homo sapiens
gcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaaggtaagcagaggctgcgccccttcggagggtgcttgggaaggcgcgggtcgagccagtggctgctgcgcgtcgcgcgtccagtgcgcacaggggcgtcccgggctgtctgggagctcggcgccaggaggggcacggcccggagacaaattcgggggcctctggcccgtcggggcttctctgacctactgagcctgggagtgaatattctgagtctcaacac

SEQ ID NO: 65302 - DNA, 2350 bp, Homo sapiens
ctccagccattggtgtctgtgtcattactaatagagtcttgtaaacactcgttaatcacggaagccgccggcctggggctccgcacgccagcctgtggcgggtcttccccgcctctgcagcctagtgggaaggaggtgggaggaaagaaggaagaaagggagggagggaggaggcaggccagagggagggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgtctggctctgtccctggggttctggggccaactgggggggtgctaaaccccaccgtcacccagtgacccaccggggtctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctacacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaacccccaggtggcctgcgtcttttttctcttcccttcccagaccaggaaaggcttggctggtgtatgcacagggtgtggtatgagggggtggttattggactccaggcctgaccagggggcccgaacagggacttgtttagagagcctgtcaccagagcttctctgggctgaatgtatgtcagtgctataaatgccagagccaacctggacttcctgtcattttcacaatcttggggctgatgaagaagggggtggggggagtttgtgttgttgttgctgctgtttgggttgttggtctgtgtaacatccaagccagagtttttaaagccttctggatccatggggggagaagtgatatggtgaagggaagtggggagtatttgaacacagttgaattttttctaaaaagaaaaagagataaatgagctttccagatttcagattctgtatttatcttcagattttgtctgcaactattttttattttttaaagaaatgaaatatcttc

SEQ ID NO: 65303 - DNA, 2115 bp, Homo sapiens
ctccagccattggtgtctgtgtcattactaatagagtcttgtaaacactcgttaatcacggaagccgccggcctggggctccgcacgccagcctgtggcgggtcttccccgcctctgcagcctagtgggaaggaggtgggaggaaagaaggaagaaagggagggagggaggaggcaggccagagggagggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgtctggctctgtccctggggttctggggccaactgggggggtgctaaaccccaccgtcacccagtgacccaccggggtctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctacacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaacccccaggtggcctgcgtcttttttctcttcccttcccagaccaggaaaggcttggctggtgtatgcacagggtgtggtatgagggggtggttattggactccaggcctgaccagggggcccgaacagggacttgtttagagagcctgtcaccagagcttctctgggctgaatgtatgtcagtgctataaatgccagagccaaaaaaaaaaaacaacgtctcgcgcaagttatccctaggaggaaaaaaaaaagattttgggactggggacca

SEQ ID NO: 65304 - DNA, 943 bp, Homo sapiens
gcatgtctatcagaggtgggacttgcagcctgtgccccacgagtttgtctctcagtggactctataggtttgctacttttgcatgacacagcaagcccagtgtcccctttgcaagctgcagagagggaaacagagtcccaggcctgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctcggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatcctgtctccagtgctcttggtactcctgtttggctgtggcctggtccctctgggccctgggatcttcttctggcccttgaggcaggtctggagaggcagtctctgtcttcatggaggggtggtcagaggcgggcgggaccaccagcctgtagcgttattattatatgtgacaataaaggtgctctcccca

SEQ ID NO: 65305 - DNA, 1056 bp, Homo sapiens
gtatgacaacagcctcaagatcatcagcaatgcctcctgcaccaccaactgcttagcaccctggccaaagttgtcatggatgaccttggccagggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctcggggagcagcctggactgcagctctcagaggccagggagaccctgaataaatcactgccagccatacggaaaaaaaaaaaaaaaaaaaaaaaaaaaaaacaaaaaacacaaagagaagacgaaagacaaaaaaacagaaaaagagaagagaaacaacgaagaacagagaaaggagagcacgaaagcgggacagagcagaaagaagaggaagcagatgaacaagagagcaaagcgtaccgagtagaacaaaagaagagaagagaacgaacgatagtccgagagagccgaagacgggacgccgccgcgaacagcacaaaagacgggcagctggagcacgagacacgacgcaccggtaggtaccaacaagtgagaagataggagaacgagagatgagcaaaacccagacagagcggaacggacagagcaagagaggacggcagcccgagcgaggcggacagcaggcagcagagcgcgaagccggaaggagccgagggcgaggcaaacagacaaagaaggaagaacgatcgcacaaagtggtgagagggagccagacaacgccggccgcgagacagcagaccacgctagtagcaacaaacaagacgagcgacagctgcaaagacagggacgcggaagcagggcgcgaaggagacgcgccacggcagcgcgagacgcgaacggcaagccgaa

SEQ ID NO: 65306 - DNA, 1183 bp, Homo sapiens
gtatgacaacagcctcaagatcatcagcaatgcctcctgcaccaccaactgcttagcaccctggccaaagttgtcatggatgaccttggccagggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctcggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatccctgagccaggggaggcagcatttcatgggcatgtctatcagaggtgggacttgcagcctctgccccacgagtttgtctctcagtggactctataggtttgctacttttgcatgacacagcaagcccagtgtcccctttgcaagctgcagagagggaaacagagtcccaggcctgctgggaagagatgctcctgcctcccaccttccagagttgggggcctggcaggctccatggcaggcaccaggtccctagcagcccagaacagctctgactggagccctcaaggcctctggggccagggtccccgtgatcagctcagccctggtgttcctctcttgctgggctgggacctgggacacagccacggcagcaaactcagagaattgaaggtgctggcgccaccctggggcactctgtcttcacagcaggagtgactgtctccagtgctcttggtactcctgtttggctgtggcctggtccctctgggccctgggatcttcttctggcccttgaggcaggtctggagaggcagtctctgtcttcatggaggggtggtcagaggcgggcgggaccaccagcctgtagcgttattattatatgtgacaataaaggtgctctcccca

SEQ ID NO: 65307 - DNA, 1435 bp, Homo sapiens
gcatgtctatcagaggtgggacttgcagcctgtgccccacgagtttgtctctcagtggactctataggtttgctacttttgcatgacacagcaagcccagtgtcccctttgcaagctgcagagagggaaacagagtcccaggcctgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctcggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatccctgagccaggggaggcagcatttcatgggcatgtctatcagaggtgggacttgcagcctctgccccacgagtttgtctctcagtggactctataggtttgctacttttgcatgacacagcaagcccagtgtcccctttgcaagctgcagagagggaaacagagtcccaggcctgctgggaagagatgctcctgcctcccaccttccagagttgggggcctggcaggctccatggcaggcaccaggtccctagcagcccagaacagctctgactggagccctcaaggcctctggggccagggtccccgtgatcagctcagccctggtgttcctctcttgctgggctgggacctgggacacagccacggcagcaaactcagagaattgaaggtgctggcgccaccctggggcactctgtcttcacagcaggagtgactgtctccagtgctcttggtactcctgtttggctgtggcctggtccctctgggccctgggatcttcttctggcccttgaggcaggtctggagaggcagtctctgtcttcatggaggggtggtcagaggcgggcgggaccaccagcctgtagcgttattattatatgtgacaataaaggtgctctccccaaacaaagaagaaaagcaataagcacaacacagctagaacaatcaggacacgcaggaa

SEQ ID NO: 65308 - DNA, 254 bp, Homo sapiens
ctgtgggtctgtttgtgtggtgacagctctgcaggaggctggtctgcatcttaccggccaggtgccagggaagctgtgagcagctccagccaggcccggggtgaccacagggcctctgtggcagggaggtccagctctgccctcaggacctccagggagggggctgggagtgacacacgataggcaagccccggattggggcttaacctgcaagggctcttggcttcacccagcaaagaattcaagggcaagct

SEQ ID NO: 65309 - DNA, 452 bp, Homo sapiens
attgtgaggacatggggggctttggggacagataatgtctccaggggcagggtctggaggggccaacaccctcatcagagccctcctctggcctgtcccctcccctacccccactcccggctggagacggggtctgggtgggctgggtgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaa

SEQ ID NO: 65310 - DNA, 1378 bp, Homo sapiens
gcatgtctatcagaggtgggacttgcagcctgtgccccacgagtttgtctctcagtggactctataggtttgctacttttgcatgacacagcaagcccagtgtcccctttgcaagctgcagagagggaaacagagtcccaggcctgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctcggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatccctgagccaggggaggcagcatttcatgggcatgtctatcagaggtgggacttgcagcctctgccccacgagtttgtctctcagtggactctataggtttgctacttttgcatgacacagcaagcccagtgtcccctttgcaagctgcagagagggaaacagagtcccaggcctgctgggaagagatgctcctgcctcccaccttccagagttgggggcctggcaggctccatggcaggcaccaggtccctagcagcccagaacagctctgactggagccctcaaggcctctggggccagggtccccgtgatcagctcagccctggtgttcctctcttgctgggctgggacctgggacacagccacggcagcaaactcagagaattgaaggtgctggcgccaccctggggcactctgtcttcacagcaggagtgactgtctccagtgctcttggtactcctgtttggctgtggcctggtccctctgggccctgggatcttcttctggcccttgaggcaggtctggagaggcagtctctgtcttcatggaggggtggtcagaggcgggcgggaccaccagcctgtagcgttattattatatgtgacaataaaggtgctctcccca

SEQ ID NO: 65311 - DNA, 420 bp, Homo sapiens
gtggcccagcattttaactattcctgtagttctggaatttaggccatttctactttttgcttttaaaagtgctgcaccaaagagccttatatatatgccttggcaggtacattacctttgaataggatttgaattgctaggttacaaattatactctttttcaacattttggtagaaattttggttgcatctgccaaactgccttctaatactacttatttatattcacaccaagagcagacataactttttctgccatgggagataattttatttaagggggtatatttggaacgccatagctaaaccaccactaactatatccaaatggtgcccaaagtttatacaaatctgcttaaaacatccagcaatgagtggataaatgaataataaactatttttccataaacagaggtacac

SEQ ID NO: 65312 - DNA, 1065 bp, Homo sapiens
aaaacattgatttgtagatttatcatatgtgtgacctacttacctcctaattttgcccttcaaaattgccaagaggttatttctttcagcaaggaattgaaaagtactttaaacaagggaaacaccttatcttgaaaagtttgtagtgtgtaccttccctaggctggaaatgaagctaagagatgttaccattgtaaaggaatccctgatatcagtagagatgatgggatcctgcagtgccagtggccaaggggtagtaccaaggcaacagagctgtagtgatgaaatacatgggttacctaccaaggttctatttggcttatagaacgcaaaacaaatcttcaggtctggcaaatagaggcctgttttgagtcaccaaaatggagatttacagacaattctcagagctgaagcccttgaaaaagggggtgcagggtactctggaggaagcacccagcaataccaccataactatatcataaatcttctcgttttccccaaagggatcttaagccatgtaactatgcatgtgtgcttagggaaatggaaatgcccaggcctttagggattacttggaaactggccctaagccagcacaaatgctgagacctaaaaagcctttgtggtccactagttagaatagaggcttccatggtgttatgggtcgaattgtgtcccttccaccaaaaatcatatgttgaagtcctagcccctagtacctcaaaatgtgcccttatttggaaaatgaggttgttgcagatataattaagatgaggtcttattggcatagggtggccccctaattcgattgttgtacatataaaaaggggaaatctgaacacaaagacatgcacataggctaagtaccatgtgaagatgaaggcagagactggggtgatgcagcagaggccaagggacaccaaggattgccagcaaaccatcagaagctgggagcggcaaggaacagatcctcccccacagcccgcggaaggaaccaattctgccaaaatctaggacttctagcttcctgaactgtgagacaataaatttctgttacttaagtca

SEQ ID NO: 65313 - DNA, 528 bp, Homo sapiens
agttgtaatgaggttctattgttgcttacagaaaagatattccatggtagggctggatgcccacgcaggccaatggccagcacatagggaacaagttgttctgttctacttgcttcatgtagcttttcttactccagtggaaaaaaaaatccaactaggtgagagtgtataaccagagacaagctgcttattagcaatacaaggaaaagtaattgtgcaatagagtaatgacaatgaaaattagtgctcatccccaggattcaagaccatagccactcagagatcacagggagcttcacatgctgtctatcacagccaagcatttacaagccaatattaatataaacagtgcactaaaaaagaatgtaaaactagacctattatgttagatcctggaaaaaaggatcttgggacagagggcaagtgtggaccaatcaaaaattcgacttttggaagagttatatttttcttttcttttttattgggtttttaatgttgtgtgtaactaaataaaatacagaaggacta

SEQ ID NO: 65314 - DNA, 827 bp, Homo sapiens
tccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaataatttggg

SEQ ID NO: 65315 - DNA, 1062 bp, Homo sapiens
tcttcagctaggtcgtagtgcccaggaacagatcagatcagaatcagtatgttgtttatgatacagatcaaattaactaatgattcttccagttttcttcttcctgattatttcctccagacacaaaatagggtcaaggagaaaagttcttttctaccattaaacttttgagctgcctgtgtttgggattcaaagtattttgggtgcttattgcttaactgggctgaagattatctcatgtgacaccatagatctcttgttttggaattgccattactttctagaacaggcattctgtacagctgccaacatgccctgaatcctcttgcttcatattacagtgatactgctttgtcagggtagaattcagcctcacagggctggagtaagtctctgctgacctcatgccacagtacaacatgttcaaatctgggagaaacctgagggttattcggcatattcctcctcctcctctctcacaagcatggagccctcactctcctcggaaaccgtatgttgtatatgtgtgtgtatctgtcttttaaaaaaaaaaaaaaaaaaatctcatcctgaatcctatagttagttagtcctgcagctttaagtgggggctggttgaatagacagacaaaggaaatagcctgagctgctgaaacttagcgtttttcagcagtagatctcagccaggggcatttgctattttaggactgacttgtgtaaggttgtaataatggagaagcataatatgtgtttcctagttgttcattttacccaaagctatttggacagaatgtagagggtgctctgtagctgtatggacatgctcagatcatcctggagtgtcccgtctcttgtgtgtaatgggctgcttcattgcagagtaagtgtcatcctcactttctcaagcgaaatagttactggaaaatcagtgtttctttcaatgaacaagagtttcatttgccttggactgcttgggaaaaacatgggttaaattcgaagatgccaggcatgcataacaaataggaatttgatttagagccacctggaatacttattaaatta

SEQ ID NO: 65316 - DNA, 453 bp, Homo sapiens
tcttcagctaggtcgtagtgcccaggaacagatcagatcagaatcagtatgttgtttatgatacagatcaaattaactaatgattcttccagttttcttcttcctgattatttcctccagacacaaaatagggtcaaggagaaaagttcttttctaccattaaacttttgagctgcctgtgtttgggattcaaagtattttgggtgcttattgcttaactgggcaacttaaccaagaccctgtctctcaaatgtataatcaaagaatgtgttcttgcagttagagacttgcgtcttttactcctgatgcattactcatctcggagtcagttatattcgatttttaaagcaaatatccggatctgactatgattcagaaattactaatgtacaggcaatagatgatgggcaggagaaagctatgaccaggtaaagctatgacatgctatacgaa

SEQ ID NO: 65317 - DNA, 170 bp, Homo sapiens
aaaaaaaaaaaaattactgcttagataagttatctcatttaaccttgatttctttgtgttaaggacagacaaaatcagtagcattgggctgataattttacagaagtattgtctagaaacctttcatttacatagaatttttatgaaatgaaggattaaatagtaggaaa

SEQ ID NO: 65318 - DNA, 270 bp, Homo sapiens
aaaaaagaaaagaaaaatatgcttcccatgggtcttccttccttgtagaaatcttattgttaatcattgtaggactgctggaaactcacaaaagtaacagctaggggatgataggagatgcgtgcagttgttgcagtcctgtatggtccctgttccatgctcctggctctagttgaaggccgtgagcagaagtcccctgtgggctgagcctcttgcgcatctctgtccaagggaggccggcctaggggcttaggttccacatggttttat

SEQ ID NO: 65319 - DNA, 458 bp, Homo sapiens
ctattatccataaatgacatatattgatcataaattaggaaagtccatagatcatttgactacatatatgagcgtatattactgggctctctattctgttccattggtctatatgtctatctttatgccagtaccatactattttgattactgtagctttgttttatatacatataaaacaaacatatacatattttttaaaagggccttattatgttgcccagcctggagtgcagtggttattcataggtgagattatagttcactacagcccaaaactcctaggctcaagtctcctgccttagcctcccaagtagcatgccactatgcccagcttgtatcaccttttaaaatcaggaagcatggggcctgtggctttattcttctttcttactactgttttggctctctggggtcctttgtggttccataggaattttaggattttttttctattt

SEQ ID NO: 65320 - DNA, 314 bp, Homo sapiens
gagaaagtgagggaccatcgtgtgaggagctgagcccttgggacagagacccaagttacatagctcttggcagggactcccttctcctaagctgagccagcttcaagaggcctaaagtcaggcagccaaactacctcttggaattgcccacactgtgggatgagaagccacgtcccccagtgccagaagcaaaagcaccagagcagggcacattcccatctatcagcagccagggcaggaggcaccacccagagtggacaccacacccacttcccaggtgggcggcccttgcgccttgcagcaccgcagtcggg

SEQ ID NO: 65321 - DNA, 380 bp, Homo sapiens
agatttttggggggcaagaacccagcctgcaccatctgaacatatgatccccttagtcacagacttgaggaagagaatgttagggagtcctacaagagcgatcaaatgcttcagcgtagaggtaaccccatcactgccactcataccctgttcagcagaacaaggagagaggcacttgtactctttccatgtgcccaaagcagtggaaaatcaagtcagtgtaagtactagcatcctatacatggatgcaaaatagttcttgccccccagatgctcaaggttgaatgatgtgcacagataaaaccaaacaaaggaaaatgatggctataacctggtgcaataagtactccattcttccagtgggtcagaaaaaaaaaccc

SEQ ID NO: 65322 - DNA, 545 bp, Homo sapiens
aacccagtaggcagaggttgcagtgagctgagattgtgtcactgcactccagcctgggcaacagagtgagactctgtctcaaaaaaaaagcaaagctaggcatggtggtgcacacctgtagtctcagctactcaggaggctgaggcaggaagagggcttgagtccaggaggtcaaggctgcagtgcattttgattatgcctcacactgaacatttgctgtgtatttgctatgtaccaagcactgtcttaagcacttaatgtagattaattcctacatataatatgcccagcagcctctgaggtaaatgatcctacagtcgaccccttatcctcaggtgatctcctccaaacccccagtggatgccggaaactgtggatagtactgaactatagactgtgttttctcgatctgataaccaagatggctcctaggtgactagtgggtgggttgcggatacagcatagacttgctgaacaaagggatgattcgcatcccaggtgggacgaagcggataacacttccgaggggatactctagaacagct

SEQ ID NO: 65323 - DNA, 537 bp, Homo sapiens
aacccagtaggcagaggttgcagtgagctgagattgtgtcactgcactccagcctgggcaacagagtgagactctgtctcaaaaaaaaagcaaagctaggcatggtggtgcacacctgtagtctcagctactcaggaggctgaggcaggaagagggcttgagtccaggaggtcaaggctgcagtgcattttgattatgcctcacactgaacatttgctgtgtatttgctatgtaccaagcactgtcttaagcacttaatgtagattaattcctacatataatatgcccagcagcctctgaggtaaatgatcctacagtcgaccccttatcctcaggtgatctcctccaaacccccagtggatgccggaaactgtggatagtactgaactatagactgtgttttctcgatctgataaccaagatggctcctaggtgactagtgggtgggttgcggatacagcatagacttgctgaacaaagggatgattcgcatcccaggtgggacgaagcgggatggcacgagatttcatcacagta

SEQ ID NO: 65324 - DNA, 453 bp, Homo sapiens
tcctcctcactcaaaacggggtcatctctcttcgttttatttggctatcatctcaccccctttaggcaccagagttataaggaggagccaacgcttttacaaacttaatccctcctttccttcaaaccagctcctttcccccaaatataaggaggaacagccagtcgcgagcaccatggcccctccagagacgaacagcgtccgctcctgctcggagcgggaagctctctggctgcggtgctggccagcgcagcctgggacgcacggccaagcgcgatgcagtcgccagcagctcaggccgtaggctgtgcctctgcccggtgccagctgttgtctggaaggccacaaacctctggagtctgtttcgtgaaaataaaaatctatggtgcatcgtgccctccaacaaaggacagcccaggctccgaagccataatctgctgtttatccctgaaa

SEQ ID NO: 65325 - DNA, 748 bp, Homo sapiens
ctttctgtgttacagtaagggaagaagtcaccacacatcccagctggaggagggaacatgactggctcacttcagcaccctcaccattgttccagatatccaaggccctccttggacctcaacaagacttaagccgctgcagagacggtgtaaatgtggagtggctggttggggacagagtgaaactcctggaatcagatggtgatctgctgataagctgggtctgtgccagccagcagagtccatgcgtgcaagagcctggagtctccccctgtgaaggcttggggctggttgggcagtaagcctcacagtaatccttagtcctgttagatgggagttctaaatttattttcaaagaattaatatgtcagtatgttcaattctttgccttctacttttaaacttaacttcctcataaagcaacctttttccattacctaccccaccctaactcattctgatcacctgctccaccctaactcattctgaccacctgctccactctaactcattaggattacctgctacctgctctgccctgactcccgccaaagctctcatcccatcattctctttcaattagccaatcggaattagtttagcctgtgtggtctaaccctagctaacaggagaatgacacagcggctgcagccaagttcgtcagggataagaaccccttcccctcccttgtccacctgggcgctcaccattgttccatctgtaagggcgcaccgttctatatagaagt

SEQ ID NO: 65326 - DNA, 375 bp, Homo sapiens
gcctttgatcagatgtcctctcttccttatcgcttgctctcatttgctgctgccctcctctcctctcttcagactatctaatggatctcaccaccctctcatcctctttgcagttcttcctgtttccaaaagagtctttcatttaagagatgtaacggggtgtggggtgaagaggtattagaaaattacgccagaggcttttatgtgtgtgatggaggcaaagctcacctcagagcagacggtccttcttctgcttctccgtctttttttttttggtaaatttttattgcttttgcagtcctcacgtaacttaatacattaatatattctcgatgtcaaaaagcaaataaagctaaagtccttcttgatcccctc

SEQ ID NO: 65327 - DNA, 277 bp, Homo sapiens
tcgtataaaattaaaacttgagaattctagctttcaatgtccttttggttgctaatgtaaagaggtgatatcaaatttctggcattatatagatatataatatatattgtgcatattattatatataatgtatatatgtattatatattatatatttatatatgtgtgtatttatacacttattggattattatatattacaaaatgttcctcagttaccatgtgtgctgtagcacagtgttaattcatgggtccttcctgaatcacaaattagaac

SEQ ID NO: 65328 - DNA, 729 bp, Homo sapiens
gaagtgagaggaggaggtgaggtgctgcgggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgagaggctgacatgggggctggaggaaggagggg

SEQ ID NO: 65329 - DNA, 2088 bp, Homo sapiens
  misc_feature (2088)..(2088): n is a, c, g, or t
agctggtacggtctggaatttgggctcccccctctgaccccgcagccaggccccaggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65330 - DNA, 2047 bp, Homo sapiens
  misc_feature (2047)..(2047): n is a, c, g, or t
gaagtgagaggaggaggtgaggtgctgcgggaggtgagctgggctggtggggacaggggcagggcttggggctgggtctccggacagaggcctggcttttctgtcagggcagggcctagcccctgcccccataaaagaggagacatagggggcttggtgagataccctgaaacctcccccctctgaccccgcagccaggccccaggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65331 - DNA, 1943 bp, Homo sapiens
gaagtgagaggaggaggtgaggtgctgcgggaggtgagctgggctggtggggacaggggcagggcttggggctgggtctccggacagaggcctggcttttctgtcagggcagggcctagcccctgcccccataaaagaggagacatagggggcttggtgagataccctgaaacctcccccctctgaccccgcagccaggccccaggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggatcctcaagagtcagctatcaccatgactgcgttgcaggcacat

SEQ ID NO: 65332 - DNA, 2284 bp, Homo sapiens
  misc_feature (2284)..(2284): n is a, c, g, or t
gaagtgagaggaggaggtgaggtgctgcgggaggtgagctgggctggtggggacaggggcagggcttggggctgggtctccggacagaggcctggcttttctgtcagggcagggcctagcccctgcccccataaaagaggagacatagggggcttggtgagataccctgaaacctcccccctctgaccccgcagccaggccccaggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggtacgaggccggtgatgcccagggacccccagccccacaagccccaggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65333 - DNA, 816 bp, Homo sapiens
  misc_feature (816)..(816): n is a, c, g, or t
ggggagggcagagctgcaggagagtgggaggcatatggctgagggcaggtttgggtgcagaactgtggaggggcagggccggcctcccagtgaataagcccccggcctgcaggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65334 - DNA, 2237 bp, Homo sapiens
  misc_feature (2237)..(2237): n is a, c, g, or t
gaagtgagaggaggaggtgaggtgctgcgggaggtgagctgggctggtggggacaggggcagggcttggggctgggtctccggacagaggcctggcttttctgtcagggcagggcctagcccctgcccccataaaagaggagacatagggggcttggtgagataccctgaaacctcccccctctgaccccgcagccaggccccaggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65335 - DNA, 2069 bp, Homo sapiens
  misc_feature (2069)..(2069): n is a, c, g, or t
ggaggaggaggaagtgagaggaggagccaggccccaggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65336 - DNA, 2004 bp, Homo sapiens
  misc_feature (2004)..(2004): n is a, c, g, or t
gaagtgagaggaggaggtgaggtgctgcgggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65337 - DNA, 1807 bp, Homo sapiens
  misc_feature (1807)..(1807): n is a, c, g, or t
ggaggaggaggaagtgagaggaggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccagcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacagaaaaaaaaaaaaacaaacacaaaaaaaaaaagaagaaaagaccggggacctatataggggggcgagaagcgtgataatgagacaggaacatagttcttagagcattttgttaacaggttgagaaggggggaccacaggggagggtatatgacaggatgcggaagaaagagagagcgaggacgttgtgagtggtgttagagggagggtatcccaacgggagacagagagagagataatattcttatatatacagggtgaataagacgtagaacgatgggtgaagn

SEQ ID NO: 65338 - DNA, 2872 bp, Homo sapiens
ctctggttatctcgggtttatgagaacggctggcattcacgtgtctaatttttaaatgatagatgaattaattattatttgatacttgccgtgttggtaggccaaaaggtgggcttctgaaacttagagggtgacagggatggagacccctggtatggggcttagatgaagcaagaggccaggcccggaacagaactcagctcagcagtcagtcacaaggctgcagagtgacaggcgtttggggaaaggtaggaaccgctctccgccacctgccggtcagtagccctacccacaatcaggccgcggctgcctcggcctggtcccaaaaattgtgaacgccgccctctcctcccgcccagtcctccgccgcgcccgcggggtcgggggctgcgctgccggcgccgcgagccgggcgagcttcccagcacgggaggagggagggggcggcgccgggcggggcggagcttccgcgcctcctggagccttattcccggccgcgagccgggcagcgctcattcggccgaaggagctacgcgggccacgctgctggctggcctgacctaggcgcgcggggtcgggcggccgcgcgggcgggctgagtgagcaagacaagacactcaagaagagcgagctgcgcctgggtcccggccaggcttgcacgcagaggcgggcggcagacggtgcccggcggaatctcctgagctccgccgcccagctctggtgccagcgcccagtggccgccgcttcgaaagtgactggtgcctcgccgcctcctctcggtgcgggaccatgaagctgctgccgtcggtggtgctgaagctctttctggctgcagttctctcggcactggtgactggcgagagcctggagcggcttcggagagggctagctgctggaaccagcaacccggaccctcccactgtatccacggaccagctgctacccctaggaggcggccgggaccggaaagtccgtgacttgcaagaggcagatctggaccttttgagagtcactttatcctccaagccacaagcactggccacaccaaacaaggaggagcacgggaaaagaaagaagaaaggcaaggggctagggaagaagagggacccatgtcttcggaaatacaaggacttctgcatccatggagaatgcaaatatgtgaaggagctccgggctccctcctgcatctgccacccgggttaccatggagagaggtgtcatgggctgagcctcccagtggaaaatcgcttatatacctatgaccacacaaccatcctggccgtggtggctgtggtgctgtcatctgtctgtctgctggtcatcgtggggcttctcatgtttaggtaccataggagaggaggttatgatgtggaaaatgaagagaaagtgaagttgggcatgactaattcccactgagagagacttgtgctcaaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgccggttaaattccatatgctccaggatctttgactgaaaaaaaaaaagaagaagaagaaggagagcaagaaggaaagatttgtgaactggaagaaagcaacaaagattgagaagccatgtactcaagtaccaccaagggatctgccattgggaccctccagtgctggatttgatgagttaactgtgaaataccacaagcctgagaactgaattttgggacttctacccagatggaaaaataacaactatttttgttgttgttgtttgtaaatgcctcttaaattatatatttattttattctatgtatgttaatttatttagtttttaacaatctaacaataatatttcaagtgcctagactgttactttggcaatttcctggccctccactcctcatccccacaatctggcttagtgccacccacctttgccacaaagctaggatggttctgtgacccatctgtagtaatttattgtctgtctacatttctgcagatcttccgtggtcagagtgccactgcgggagctctgtatggtcaggatgtaggggttaacttggtcagagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggcccacagcgtgggaactcactttcccttgtgtcaagacatttctctaactcctgccattcttctggtgctactccatgcaggggtcagtgcagcagaggacagtctggagaaggtattagcaaagcaaaaggctgagaaggaacagggaacattggagctgactgttcttggtaactgattacctgccaattgctaccgagaaggttggaggtggggaaggctttgtataatcccacccacctcaccaaaacgatgaaggtatgctgtcatggtcctttctggaagtttctggtgccatttctgaactgttacaacttgtatttccaaacctggttcatatttatactttgcaatccaaataaagataacccttattccata

SEQ ID NO: 65339 - DNA, 1911 bp, Homo sapiens
attacaggcatgagccaccgtgcctagctctatgcctgttttcaagcagtgtaactcatctgtcatgagacctggaacaagttactgtctttctgaggattgtaaccttgtagtgattgtaatgtttgtccatctacctcataaggatgttgtgaggatcacgtaaatgaggtgaaagctatttgtaaattgcatcctgctattagagacaggagttcctcggggcagttgggcctttgaccagagtttgggctgccctactgcctgggcttttccaagtagtagaggaaaccaccatggcagagttctttggaaggacctgctctggacctgcactttgtcatagcaggcagggcttattcacaaaacttatcttcctcaggtaccataggagaggaggttatgatgtggaaaatgaagagaaagtgaagttgggcatgactaattcccactgagagagacttgtgctcaaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgccggttaaattccatatgctccaggatctttgactgaaaaaaaaaaagaagaagaagaaggagagcaagaaggaaagatttgtgaactggaagaaagcaacaaagattgagaagccatgtactcaagtaccaccaagggatctgccattgggaccctccagtgctggatttgatgagttaactgtgaaataccacaagcctgagaactgaattttgggacttctacccagatggaaaaataacaactatttttgttgttgttgtttgtaaatgcctcttaaattatatatttattttattctatgtatgttaatttatttagtttttaacaatctaacaataatatttcaagtgcctagactgttactttggcaatttcctggccctccactcctcatccccacaatctggcttagtgccacccacctttgccacaaagctaggatggttctgtgacccatctgtagtaatttattgtctgtctacatttctgcagatcttccgtggtcagagtgccactgcgggagctctgtatggtcaggatgtaggggttaacttggtcagagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggcccacagcgtgggaactcactttcccttgtgtcaagacatttctctaactcctgccattcttctggtgctactccatgcaggggtcagtgcagcagaggacagtctggagaaggtattagcaaagcaaaaggctgagaaggaacagggaacattggagctgactgttcttggtaactgattacctgccaattgctaccgagaaggttggaggtggggaaggctttgtataatcccacccacctcaccaaaacgatgaaggtatgctgtcatggtcctttctggaagtttctggtgccatttctgaactgttacaacttgtatttccaaacctggttcatatttatactttgcaatccaaataaagataacccttattccata

SEQ ID NO: 65340 - DNA, 378 bp, Homo sapiens
ataatgataataatgtatttctttggtcaactcagcagattaggatactataagatgtgtaatttctataagatttgtaattatagaaagaatccccagttctttgctggaattttgggaaatgctcaaagagagcagtttagttttatgtcatatagcatcgaattctaaaaggtaagctagacgtctttgcattcaaaaagataattatgaagattttcatatgcacgtgggttgtttgcagctcattagaaattttgcaaaacaataatgatatatacatttaaaataggtttatgtgtactttacatagtgacactgtagaaaaaaacttgttcttcagctgctcgtatatgaatttatcgtccatagtctcct

SEQ ID NO: 65341 - DNA, 399 bp, Homo sapiens
ggcatggtggcatgcacctgtggtcccagctactcaggaggctgaggtgggaggatctcttgagtccaggagattgaggctgtagtgagccgtgttcacaccactgcacttcagtccaagtgacaaagtgagaccctgtctcaaaaacaagaatgtaatgtcgtgtgctaactaggagaccaatactgaaagaaagggtcttggtcctacgtacaagagatgtctgtttaaatgttcttggttaaaataagatgtttaaagtgttaagatggccgttagtgctatttgccatatatttctagctccacacttggccagcatttgaccccatttagcttgagtgcggccatgtgattaattttggccagtaaggtgtgaggccatgtgattacatctggc

SEQ ID NO: 65342 - DNA, 492 bp, Homo sapiens
gacactatttctcaccattttgtggaaatggcctggggaacaaagactgaaatgggccttgagcccacctgctaccttgcagagaaccatctcgagccccgtagatctttttaggacctccacaggctatttcccaccccccagccaaaaatagctcagaatctgcccatccagggctgtattaatgatttatgtaaaggcagatggtttatttctactttgtaaaagggaaaagttgaggttctggaaggataaatgatttgctcatgagacaaaatcaaggttagaagttacatggaattgtaggaccagagccatatcattagatcagctttctgaagaatattctcaaaaaaagaaagtctccttggccagataactaagaggaatgtttcattgtatatcttttttcttggagatttatattaacatattaagtgctctgagaagtcctgtgtattatctcttgctgcataataaattatccccaaa

SEQ ID NO: 65343 - DNA, 485 bp, Homo sapiens
aatgtggaagaagtgacgtactgggacagccgacggttggtcgtcagagcccttgaatctcctcattcggagctcctgaaaactttctacaagtcagtgccttgtaagaaatcctacaaccctgatgccaccatgctgtgagaaagcccaggctacctgagggaagagggcctggaaaataaggcaccaaatggagcgtgaaggacaaggagcaccgaggttccagatatgtgagtgaagacgccatcttggaagtggatcctgttgccctagtggaccccaagtgaatcaaacagaaattacccactgagcccttcctgaattcctgtcccacaaaaccatgcgcaaaataaaatggctgttttaagccaccaaatgttgagacagctcgttacccatcaatagataagagaaattgccatttttgtaccactttcataattttgctatatgaatgtattattaaaagtttcttcctttaaatt

SEQ ID NO: 65344 - DNA, 491 bp, Homo sapiens
tgagtcagagtctcactcttgtcgcccaggctggagtgcagtggtgcaatctcggctcactgcaacctccacctcccaggttcaagagattcccctgccttagcttctccagtagctgggattacaggcgtgcatcaccatgcccggataaatttgtatttttagtagagacagggttcctccatgttggccaggttggtcttgaactcctgacctcaagtgatccatccgcctcggcctcccaaagtgctgggattacaggcgtgagccactgcaccctgcctatactacattatttaacaaaaaaggatcaattggtgagaaaatgaaagctctacaagggaaagcatattacctgttttattcattgagtattcttagcacacagaagagctttcgagtgaattaatgctattatatatcctacattttaaaacctatttattttaaaataagtttgggtcgacgcggccgcgaatttagtagtagta

SEQ ID NO: 65345 - DNA, 469 bp, Homo sapiens
tgcaacaccccctcgacaccactctcaccaggcccagatccagtgaaacatagtctaactgcctgacaattcagtcacaaattcacaggactaaatagcaagcgtgctcaagttttgctctgttatttgcatctaaaaggatgggtgggttaggttaagtgatcttaaaattgtgtagtcccagctacttgagaggctgaggtgggaggattgcttgagcctgggaggtcaaggctgcagtaagccacgatccggccagtgctccccagcctgaatgacaatgagaccctgtctcaaaaaaaaataaaaagatctcttgcggccctcagacgcagtagaaaaatcctcttgttacgttggtaccagcggccctttggattagggtggggcgctccaagacttactcattcagagggtctgtttttcttgaataacttaacttgtatccgtgcattaagataagttatgc

SEQ ID NO: 65346 - DNA, 876 bp, Homo sapiens
tcgacccacgcgtccgggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccacccaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaa

SEQ ID NO: 65347 - DNA, 1057 bp, Homo sapiens
agttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttctcacccctctgtccttttgagctcttttttgctctgtctcttcatttgccttttgcactctcaaactctttcatcttcccattcgctgtctgtatttctccataactatatctttcttcctctgtctccgcccacccacatttttctctttccctttctctctttggggaccctcccccatgctcccctgccccatccccttttccccttcccgtcttctcatccctccattcccatctttccccagcaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccacccaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaa

SEQ ID NO: 65348 - DNA, 380 bp, Homo sapiens
cctgccccatccccttttccccttcccgtcttctcatccctccattcccatctttccccagcaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccacccaggaacccgaagtggggagcacctgtttggcttccggctggggcagcatcgaaccagagaattgtatgtgggggcagactgtgtagcccaag

SEQ ID NO: 65349 - DNA, 903 bp, Homo sapiens
tcgacccacgcgtccgggcccctggacacctctgtcaccatgtggttcctggttctgtgcctcgccctgtccctgggggggactggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgacaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccacccaggaacccgaagtggggagcacctgtttggcttccggctggggcagcatcgaaccagagaatttctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtgggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaaaaaagaatttaaataaacttcaggggg

SEQ ID NO: 65350 - DNA, 991 bp, Homo sapiens
agttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttctcacccctctgtccttttgagctcttttttgctctgtctcttcatttgccttttgcactctcaaactctttcatcttcccattcgctgtctgtatttctccataactatatctttcttcctctgtctccgcccacccacatttttctctttccctttctctctttggggaccctcccccatgctcccctgccccatccccttttccccttcccgtcttctcatccctccattcccatctttccccagcaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccacccaggaacccgaagtggggagcacctgtttggcttccggctggggcagcatcgaaccagagaatttttcattttttgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccagtaaaatcaaatgtgcatccaaa

SEQ ID NO: 65351 - DNA, 365 bp, Homo sapiens
ttagaagtccagcccagtcttcaatagacagatcttcatgttaaaagcttcaccggcattgagagtcaaaatcagcctcttctaagttgtagtctttagtcttacctctaccctccgaagccacccagaaacatttctgctcctcctccacgtgaagtccttccaacaggtgataactgatgatgtttcccatgcctttaccggacgaagcatccccattctgcctaaagcatggttctaaaacctttcatccacttggagatctttctctggatgcatttccatttgtcaattaatgtttaattctcttactgtaattttcttaattttcaatacaagtatttccttctctactgaaaaaaaaa

SEQ ID NO: 65352 - DNA, 4594 bp, Homo sapiens
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcggcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccggacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 65353 - DNA, 3476 bp, Homo sapiens
  misc_feature (1)..(1): n is a, c, g, or t
  misc_feature (1723)..(1723): n is a, c, g, or t
ngggcttgtcgtgcagctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacagtttattgctggattacatttattgatttgcggatattgaaccagccttgcatcccagggatgaagccaacttgattgtggtggataagctttttgatgtgctgctggatttggtttgccaatattttattgaagatttttgcatcgatgttcatcagggatattggtctaaaattctctttttttgttgtgtctctgccaggctttggtatcaggatgatgttggcctcataaaatgaattagggaggattccctctttttctattgatttgaatagtttcagaaggaatggtaccagctcatctttgtacctctggtagaattcggctgtgaatccatctggtcctggacttattttggttagtaggctattaattatggcctcaatttcagaacctgttattggtctattcagggattcaacttcttcctggtttagtcttgggaggaggctgtatgtgtccaggaatttatccatttcttctagattttctagtttatttgcatagaggtgtttatagtattctctaatggtagtttgtatttctgtgggatcggtggtgatatcccctttatcattttttattgcgtctatttgattcttctctcttttattctttatgagtcttgctagtagtctatcaattttgttgattttttcaaaaaaccagctcctggattcattgattttttgaagggtttttttttttttgtctctatctccttcagttctgctctcatcttagttatttcttgccttctgctagcttttgtgtgtttgctcttgcttctctagttcttttaattatgatgttagggtgtcagtttcagatctttcttgctttctcctgtgggcatttagtgctataaatctccctctacacactgctttaaatgtgtcccagagattctggtatgttgtgtcctgttctcattggtttcaaagaacatctttatttccgctttcatttcgttatgtacccagtagtcattcaggagcangttgttcagtttccatgtagttgagcggttttgagtgagtttcttaatcctgagttctagtttgattgcactgtgttctgagagacagtttgttataatttctttcttttacatttgctgaggagtgctttacttcccactgtgtgatcaattttggaataactgcgatgtggtgctgagaagaatgtatattctgttgattggggtggatagttctgtagatgtctattaggtccgcttggtgcagagctgagttcaattcctggatatccttgttaactttctgtctcattgatctatctaatgttgacagtggggtgttaaagtctcccattattattgtgtgggagtctaagtctctttgtaagtctctaaggacttgctttatgaatctgggtgctcctatattgggtgcatatatatttaggatagttagctcgaagaaggtatcttctatttctagtctgctgcaaaggctctgttttgtttccattggaaacagatgttgaattttctgtgtctattaaaatgattgtatagtttatctctctaaatttgttaatatgataagtcacattgatagattttcatattataaaacaacctactatgtgagatttatcccaggaatgtgtaggttgttttatctgtttgttttaattaggatcattctggtctcacaaaatgaattataaaatattttctccttttcagttttctgaagtgtatctgtcttctcagagaatcactgtggttaaaattgatagtatttttttcttaatcattttttagaattcaccagtgaaggcatctgggcttagaccttttcttgcaagaaggtttttaactactaatttagttatttaatagatatagatttacttagattatctgtttcttcttgagtgatctttggcagcttgtgtgttttaaggaacttgttcattccatgtaaattatcaaatttattggaaaaagttgtttatgacattccgttactattcttttgaaatctgttgagattatagtgatattagtctcatcttgatattggtaatgtgtgtctcctctgttttttttctagatcagtttggctagatagctatgacatttatttgtattttcaaagaatcaactttcggttttatctgtttttgcttattgtttcctatttcattgatttatcctctaatttttattataattttctttgtttggcttactttgagtttggttttctccgcattttaatttttgaaatggtagctgaggctattgatttgagacctttcttgtaatgtagtcattccctcttaactactgctttagtagtatctcaaagattgtgttatgttgcgttttcattttcattcagttcaaagtatttccaatttcacttttgttttcttctttgacttatgagttatttagaggcatgccacttcgttttcaaatatttgggagttttttcagaaatttttgttgttgatttttgattccgctatagtcagaaaatatgtttttatgactttaaacattttaaatttattgagactagtttttggtctagatggtctattgctgtattcagtgttcactttaaaataatgtgtatccacttatttatgggtattttataaatgcctgttagataaaatcggttaattatgttattcaagtcttctggagcctttctgattttctgtctatcaatatttgagagaggggtattaaaacctctgattatggactt

SEQ ID NO: 65354 - DNA, 2381 bp, Homo sapiens
  misc_feature (1)..(1): n is a, c, g, or t
ngggcttgtcgtgcagctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcagtaagtcaggagataagccagaatgcgtatctgactccagtctcaatgtctaccccttcacaaaacggtagcctccagggtagtcctcagcaaagcgttggcaccttactgaatctgtttttccatctgagaaatgggccaacggaaaaatcaaacttccattctggggaagtcgagaaccgggactccctaggaagggcagtgctttggcctcatgttctgtgctctgacagagagctgcactagagacaagtttatccatgaacacattgctctgtaaaggaatgttttgcctactcagctgggaggccgacagcagaggcagacttggggagtacactctgcagcccctgtccctgcagactgaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 65355 - DNA, 896 bp, Homo sapiens
ctctgtcttctctgtctcttatttgtgctttcttttctctcttctttttctgttttgtttcattcgtttcttttgtattcttttcctttgtttttatgttgcttcttcttctttttgtccctttttttgtttgtttttttcttgtttcttttttttttcttttttttctttttgtttttttttttttttttctctttttctttcttctttcttctttttttttttctctcttttgttttttttctggttcctttttgcttcttttgtttcttctctcttgtttctcttttttttcttcttctcttttccctttttttctccttcttttccttgcctctcttttgttgtttcttgcttggacatgctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 65356 - DNA, 1763 bp, Homo sapiens
  misc_feature (1)..(1): n is a, c, g, or t
ngggcttgtcgtgcagctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 65357 - DNA, 2012 bp, Homo sapiens
  misc_feature (1)..(1): n is a, c, g, or t
ngggcttgtcgtgcagctggccccaagcgcgcggggcaaggcggccctgcaggggtgagctttcctctgagaacccggggccttagcgacacgtaatccagttttccgtctccttggtgcagatgaagaaaccgacgcccatgggcgaaagggacctgctcaagttcactcaagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccgaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctcttt

SEQ ID NO: 65358 - DNA, 4004 bp, Homo sapiens
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcggcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccggacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccagcctcctggaatcctttatgagcctccaggacataaatcttctggaaaggccgccgggccgcccacagaggccaggcaatccactcagtaatgtctcctggaggatatctgagattgctccaacatcccacactgatatgtcagcaggaatcaaggaaactgcctcctaatctatcctggtgctgctaataagctcactgtgcaaccctgggctctgccgctttctggccctcagtctcctcacctataacatgataaggacgaactagaacagt

SEQ ID NO: 65359 - DNA, 11967 bp, Homo sapiens
agcgaaccatcggggcggccgggagccatgttggagcggcgggaggcggcagcagcgtcggggatgctgtggtgggggcggaaaaagccagggccgcacgccggaggggctccggccgcggagtagatggtgcccagagggcggcgggggtgcggagagacaggcggaggggcgggggcccggggcggcggcaggggcccgggagggggcccgagcggcggggccagcccaaggcccggaccggggcggggggcggtggaggccgtgcagggaggcgggagatgatggcgaggcggccgccgtggcggggcctcggggaacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactgacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggcgcagactccgactctgacagtgacctgtccttggaggaggagaggagtctctccattccatcttcagaaagcgaggacaatggccggacgcgggggcgcttccaacggccactctgccgagcagcccagagtgagaggctcctcacccaccccaaagatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgcagtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctgaggggatgacggcgtggacgaggaacagctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcagagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagagggtcggtggaggggtcattcacctgcccctgcagcaagcaaaagttgtctgtggtgccatttgattccctgacactgccccctgcttgaattgattccgaagggtagggtgggaaggtgagcaaagggagcagaaacaagggaattcaagacccagaatgtaggtgccactgcctcctatgtttacaggatcctccgtggccctaggcacctgggctgcaggaagtgactccgttccactcctcctttattcccttaaaaagggaaaaatgactgttacgaccctgttcacaaaactcttacttttgctattttgtctgctgtccagaactgaagactttaaaattttgttactgtttacaagtccagattcaaaaaatgtttttactttgtttacaactcaaaactttgagttttacactttgtttacagtagataattttttttcctttgtttccaagtgaaaggtagggaaagtgggagagggacttggaggacccacctgtgaggaccctgacctggccatcttgaggggttttctaacccccaggtctcccaggccgaaggtcagccttgagtcccgtttaacagcagatccagaagaccttgagagtaggcgtcctctaaccacgggggagagtggctgtgcagggctggggggtggtctgtgcagacacctcctcacccaccaccccatgcatactcttgggaagcagcttcctgggagattagaaattctacttccctgactggagctaaatcccaccagccaggacccaaactctccttaccgagaaggaccccagctcttgaagggctgagtggcctgctgggggtgggagggtgtctttactatgtcctaggtttcgtagatgcccctctctggggttcccctcctccagcccagcggccctctttcctgtctgtgtaaattgttccgtgaagccgcgctctgttttgggaataaacttctatagaaaacaaaaaa

SEQ ID NO: 65360 - DNA, 2905 bp, Homo sapiens
tggctggtagagccgggtgttatcggcgagggtggatggatgaatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgcagtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctgaggggatgacggcgtggacgaggaacagctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcagagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagagggtcggtggaggggtcattcacctgcccctgcagcaagcaaaagttgtctgtggtgccatttgattccctgacactgccccctgcttgaattgattccgaagggtagggtgggaaggtgagcaaagggagcagaaacaagggaattcaagacccagaatgtaggtgccactgcctcctatgtttacaggatcctccgtggccctaggcacctgggctgcaggaagtgactccgttccactcctcctttattcccttaaaaagggaaaaatgactgttacgaccctgttcacaaaactcttacttttgctattttgtctgctgtccagaactgaagactttaaaattttgttactgtttacaagtccagattcaaaaaatgtttttactttgtttacaactcaaaactttgagttttacactttgtttacagtagataattttttttcctttgtttccaagtgaaaggtagggaaagtgggagagggacttggaggacccacctgtgaggaccctgacctggccatcttgaggggttttctaacccccaggtctcccaggccgaaggtcagccttgagtcccgtttaacagcagatccagaagaccttgagagtaggcgtcctctaaccacgggggagagtggctgtgcagggctggggggtggtctgtgcagacacctcctcacccaccaccccatgcatactcttgggaagcagcttcctgggagattagaaattctacttccctgactggagctaaatcccaccagccaggacccaaactctccttaccgagaaggaccccagctcttgaagggctgagtggcctgctgggggtgggagggtgtctttactatgtcctaggtttcgtagatgcccctctctggggttcccctcctccagcccagcggccctctttcctgtctgtgtaaattgttccgtgaagccgcgctctgttttgggaataaacttctatagaaaacaaaaaa

SEQ ID NO: 65361 - DNA, 418 bp, Homo sapiens
tgatccccaggtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggtaggcctgaagcttccaccagcctagcccatggccctgtccccatcatagggaggaagtggaggactccatacctgacttcaagccagtctcctttggtggcaagcaccatgctacagcccagattttagggcctgactcttaccaaccccactcatcgaaagaaaatgggaaatggggctgagatcttggtctctttcagcccctctggacactaaagtcctgtccagcacttgtgcccccc

SEQ ID NO: 65362 - DNA, 442 bp, Homo sapiens
tactctggccccagtcccaccaatgacccagacccctgatccccaggtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggtaggcctgaagcttccaccagcctagcccatggccctgtccccatcatagggaggaagtggaggactccatacctgacttcaagccagtctcctttggtggcaagcaccatgctacagcccagattttagggcctgactcttaccaaccccactcatcgaaagaaaatgggaaatggggctgagatcttggtctctttcagcccctctggacactaaagtcctgtccagca

SEQ ID NO: 65363 - DNA, 2805 bp, Homo sapiens
aacaactactgactagtacgaaggccccgtgttaatcgcacgaggtggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgcagtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctgaggggatgacggcgtggacgaggaacagctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcagagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagagggtcggtggaggggtcattcacctgcccctgcagcaagcaaaagttgtctgtggtgccatttgattccctgacactgccccctgcttgaattgattccgaagggtagggtgggaaggtgagcaaagggagcagaaacaagggaattcaagacccagaatgtaggtgccactgcctcctatgtttacaggatcctccgtggccctaggcacctgggctgcaggaagtgactccgttccactcctcctttattcccttaaaaagggaaaaatgactgttacgaccctgttcacaaaactcttacttttgctattttgtctgctgtccagaactgaagactttaaaattttgttactgtttacaagtccagattcaaaaaatgtttttactttgtttacaactcaaaactttgagttttacactttgtttacagtagataattttttttcctttgtttccaagtgaaaggtagggaaagtgggagagggacttggaggacccacctgtgaggaccctgacctggccatcttgaggggttttctaacccccaggtctcccaggccgaaggtcagccttgagtcccgtttaacagcagatccagaagaccttgagagtaggcgtcctctaaccacgggggagagtggctgtgcagggctggggggtggtctgtgcagacacctcctcacccaccaccccatgcatactcttgggaagcagcttcctgggagattagaaattctacttccctgactggagctaaatcccaccagccaggacccaaactctccttaccgagaaggaccccagctcttgaagggctgagtggcctgctgggggtgggagggtgtctttactatgtcctaggtttcgtagatgcccctctctggggttcccctcctccagcccagcggccctctttcctgtctgtgtaaattgttccgtgaagccgcgctctgttttgggaataaacttctatagaaaacaaaaaa

SEQ ID NO: 65364 - DNA, 11133 bp, Homo sapiens
agcgaaccatcggggcggccgggagccatgttggagcggcgggaggcggcagcagcgtcggggatgctgtggtgggggcggaaaaagccagggccgcacgccggaggggctccggccgcggagtagatggtgcccagagggcggcgggggtgcggagagacaggcggaggggcgggggcccggggcggcggcaggggcccgggagggggcccgagcggcggggccagcccaaggcccggaccggggcggggggcggtggaggccgtgcagggaggcgggagatgatggcgaggcggccgccgtggcggggcctcggggaacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactgacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggcgcagactccgactctgacagtgacctgtccttggaggaggagaggagtctctccattccatcttcagaaagcgaggacaatggccggacgcgggggcgcttccaacggccactctgccgagcagcccagagtgagaggctcctcacccaccccaaagatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgcagtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctgaggggatgacggcgtggacgaggaacagctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcagagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagaggcgcaggactgaggatagtatggggtactgtaggctggggtggagcatggaggagatggggatgtctgaggggcctgggctatggggtcccagcatcccacaggggcatatgaggactttgagctgtgagatgcaaccccccaatagtcttcc

SEQ ID NO: 65365 - DNA, 9038 bp, Homo sapiens
agcgaaccatcggggcggccgggagccatgttggagcggcgggaggcggcagcagcgtcggggatgctgtggtgggggcggaaaaagccagggccgcacgccggaggggctccggccgcggagtagatggtgcccagagggcggcgggggtgcggagagacaggcggaggggcgggggcccggggcggcggcaggggcccgggagggggcccgagcggcggggccagcccaaggcccggaccggggcggggggcggtggaggccgtgcagggaggcgggagatgatggcgaggcggccgccgtggcggggcctcggggaacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactgacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggtggagttggggcctggggcagggaggagggaggcagaggatctctccccatccccttttcttctaccccatactgggagcagtggctgact

SEQ ID NO: 65366 - DNA, 15396 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccctgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggcctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggccgtgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggtcggggagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagcaaaaaaatgttg

SEQ ID NO: 65367 - DNA, 176 bp, Homo sapiens
  misc_feature (47)..(47): n is a, c, g, or t
tatatggcatagctgttccttgatgtacacttgtaatctagcagagntaagacggactgtcctctggccctaacatcttatactcacgctttctctctctctctctgcaggtctttccctagcaactactgggacaagtttgtcaagcgcaaggtgagaggacatggatgccctgg

SEQ ID NO: 65368 - DNA, 15309 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccctgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggcctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggccgtgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggtcggggagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagcaaaaaaatgttg

SEQ ID NO: 65369 - DNA, 6704 bp, Homo sapiens
  misc_feature (22)..(22): n is a, c, g, or t
ggagaagaagaaaaggaaaccnaatagctgtaaataaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggtcggggagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagcaaaaaaatgttg

SEQ ID NO: 65370 - DNA, 9021 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccctgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggcctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggccgtgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttgccgctgaaaatgaactttatgaaccttttccaag

SEQ ID NO: 65371 - DNA, 3585 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccctgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcgtgggtacctccctgggcaccattctgccaggtcctgtggtctctcccacagcttgtctactctggccctgcct

SEQ ID NO: 65372 - DNA, 1943 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatctgacccatcttatacgtcctcacactcattttcaacctcctgtcaaaacacatagcat

SEQ ID NO: 65373 - DNA, 514 bp, Homo sapiens
gtagctgggattacaggcatgcaccaccacgcccggctcatttttgtatttttagtagagacagggtttcaccacattggccaggctggtctcctgacctcaagtgatccatccgccttggccttccaaagtgctgggattacaggtgtgagccactgcatccggcccccaggaggatttaatctctggccccacagctcagaatcctaacttcaggggaaccctgacctctgcccttcatttcagagctacgggagcatccaagggagcactttccattagggtttccaggatgcaatctccacaggagcctccaatatctgtcccttttctcttgttatcattggttctgtgggacctgtgacgtctgacccatctctggtgactgatgcaggacacgtggcacgcccagtgacttccccagggcagcacctcctggcccctgaagacgtgatcagctgctgcctggacctcagcgtgccgtccatctccttccgcatcaacggctgccctg

SEQ ID NO: 65374 - DNA, 241 bp, Homo sapiens
aatgttcatctgcatggccagatgaccctagaaaccccatccctctgactggatgtctcctggtccccatctcctcctccaagatctctctctgggcagcccccttccctgggatccccaccccctccctcacctcccctccgctgaccccagggcgcagtggctgacggagccgaatcccagcgcggaggagctgttcaggatggtgggcgagatcttcatctactggtccaagtcccac

SEQ ID NO: 65375 - DNA, 310 bp, Homo sapiens
cacctgtcgaccgccagtggggagctccaggttgacgcttccttcatgcagacactgtggaacatgaaccccatctgctcccgctgcgaagagggtgagggccccagacctccccctaaatggagatccccccaaaacagacccttaatgttgcccttcaggcatacccaaatggagccttggaacctcagacctcaaacctagatctccaaattatggctctcacacttagatctccagctgaccccaaatccagacccccagagctcagaacccccccaaaccccgaactaaatatcaggctcccaaa

SEQ ID NO: 65376 - DNA, 407 bp, Homo sapiens
gaccagattccggggagctgaacccttgacttcactctcttctgtgtccccagacttgtctactatgaggggggagctgtgtgcactcatgcccgctccctctggaggctggagccactgagaatcaggtagggcggggaagatggggagagaccagggagaggctggggtcacctggcaggctgggaggacagaaaaggtcttgagggaagatctgataaagagactgaagggtctcgagggaaaatcagagcagcctgagagagagatgaaaatctcggccaggcgtggtgacttcatgcctgtaatcccagcactttgggaggctgaggcaagaggatcactggaggccagaagttcaaaaccagcctaggcaacatcatgagacccccgtctctgcaaaaaaa

SEQ ID NO: 65377 - DNA, 12498 bp, Homo sapiens
ctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggcctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggccgtgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggtcggggagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggagtcttatgtctggaagatgtaccaagagagatgttgggatttcttcccagctggtgattgtttccgtaagcagtatgaggaccagcttagctgacacacccccagctggccctccacccccacctcaagtgccttattctcacagcaagccccttagtccccaagcccctccccctaaggcagctgggggagaggtgacctagtactggaaaataaatctgtgctacgccccccagcaaaaaaatgttg

SEQ ID NO: 65378 - DNA, 10849 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccctgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggcctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggccgtgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggtcggggcttggttctgggaggagcacttggcagagagggcgggagcaccctctaggacttcctacctggcctgtcctcacccagccagcccgtcctgggcgcaatccctgcagtcctcagagcagcccctcttacctcctctccctctcccttcctccccagctccttcctcctcctgtatcttctccctcctcccatctccctcctcctctccatctccctcttctctcatctctgtctccttcctcctcctgtatcttctccctcctcccatttcc

SEQ ID NO: 65379 - DNA, 6562 bp, Homo sapiens
  misc_feature (6016)..(6016): n is a, c, g, or t
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccctgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacaacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggcctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggagagtctttgatgttcccattcgcagacgccgctgctcacgccttttttagcaagccttctgctgatggaagcactaggatgattctaggctgttaaatagatttctcaataatgtaaataactaaatgttctctgcatatagcaggaaaactagcatgaaatattgtttcaggccctgggttctatgtgacactacattaggaantggactgttgggtttgctttgtgtttttgaggtagaggaagaaatgggaatcttttttttctcttccaggagtcagtggaagaatagttctctagctaaggaacggacataccttgtgttttaaaatattttatacttacaaaaatctagaaatggagaggggaactgttttgaataaggatttaaaatacctggacaggattgagagaactatgtgactcattctgtggaaaagactctgcggtgtgaggtatttgaactgctcccattgtagtggctatccatgtagggaatccctaaaattttggtcgccccggggaacttgttgggctaaacaactgaacggcgtgtgtggtgcctgaacagcggcgtcgtgataaagactatggcgaagcgacgctattctaccagcgtataattcgtgctcgagaacgggataagtccacggcatattgctctcgtggttttggtgcatactgctatctgctgtgttttaagtacttatatatttgtatttgaggatagaaaacaggaagaacacagagc

SEQ ID NO: 65380 - DNA, 1671 bp, Homo sapiens
tctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactgtggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgccgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagctaccctccaaaccaccacagtgtctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtatgtgcgaacagccctccaaagcctatgccacagacagctcttgccccagccagaactcagccatatcacgctcgccgtctgtccagtcattctaccataaggtcgcaggtt

SEQ ID NO: 65381 - DNA, 276 bp, Homo sapiens
gaagcaagagaagtttcaaggaagtcctgatggtctcacctccatctctcctcccacacggctgtccttccacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacag

SEQ ID NO: 65382 - DNA, 2345 bp, Homo sapiens
  misc_feature (48)..(48): n is a, c, g, or t
  misc_feature (457)..(457): n is a, c, g, or t
  misc_feature (680)..(680): n is a, c, g, or t
  misc_feature (728)..(728): n is a, c, g, or t
  misc_feature (1082)..(1082): n is a, c, g, or t
  misc_feature (1267)..(1267): n is a, c, g, or t
  misc_feature (1784)..(1784): n is a, c, g, or t
  misc_feature (1795)..(1795): n is a, c, g, or t
  misc_feature (2210)..(2210): n is a, c, g, or t
tacttcaatttttaaaagcattaaaatatgttagcttgtatagatacnactagaaaataaaaagttagatgaactttttctcttgggtgaatttttagacagtgtaagatagatgacagaccacactgacaagtagttcaagaatctgatttttgtggagaattttttttaactattatatttgaggtgttcagtgaaaagttattttcctttccataccttccccccatctcttagtttccttctgcagaggcaaccagtgttacctgcaagtttcttctgcatccttccagagatacgccaggcatacgcatgtgcatgtgcaaatataatccctcctttttgcttattaaaagttattttgcacaagggacccatgagtctaatggcaatgggacactttaagcctcactatccagatcagcctctgctcttcattgttgtggggttttttttnaattgttattaaaagtacattttggagagcaaactaagtcagatttggggggatttttatcactcaacattttgttgtgaaatgccctacatatagggaagttgaaacaatattataccaaccatcctctaccagatggaaaaattgcaaacgttttgccatttttgcttcttctttctctttctctgccattatgacatttcacctgtacaaaattcagcangcatctcctaagaataaggatatttttctacataaccacaatagtaanaatcttaaacatacttccagaatatccaatctatattcaaatttccacagttgtcccccaaaacatgtcttttacagattttacttccagaccaagttcaaatccacatttatggcctacatttggtgtcttagtttcttttcatctaatcagtcaccacacatttgttgttatgtttatttagaaataagttgttagactctgtgtatatgttttgtgttagtagaaaatgataatagttgtagtaggatgcatcggagtaaaaaggaaaaggctgatcagggccagaggtcaatgactgacctgggggttctgggaacctcaggcccaaagtagttataatgggacttaggngatcattatctcagctcacctgtaacctatactttggcatattgattgaaaggctctgggttattaaaaaaaaaggtgacagagttaaaaataacagtaacagtgacaagcaagatagaaatatatttctctttcatgcagcacagctctgctccacaaagccttcaaggctgattgataggtgntctgtggtataagagactaagtctctagggtattatcattatccaggtggtccgggatgactcaccacccccagattttagtcagtcggaagtggggagatggtataccctgcaagttgctcagtacctccatgcatgtctgactggccagaacttaatctaagcttcaagggaggttgggaagtgtagtcttcattctggggagccatataccagctaaaagtcccagtatcttagaaggggaccagtatggggaccatgaatactttctgtgacagacttaatactttattaataccacttataaccagataatactttactatttataaaacatttgctttgcaagccaggtctacactgccttcataaaaagtatttctaatactataaaactttgttcataaatcattttgcttttgaattaactaagcaaaccaaactaagaaaccaaatttgattcttttgacaacattaatcatgaatgttcagtaactttacaaccctccacttgganaggggaattantagaaacaaattattattgtaactctacagcattttagactttgccttacaaaatactttcagggatgtttaaaagtgtatagctgccagtttatttaaaaacgactagaataataggtccaacttcacaagggtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatcccagcactttgggaggccaaggtgggtggatcacttgaggtcaagagttcgagactaacctggctaacatggtgaaatcctgctctactaaaaacacgaatattagtcgagtgtgggggcatgaanctgtattcccagctactcaggggactgaggcacgagaatcacttgaacccaggaggaagaggtttcagtgagcctagtttgcaccactgcactccagcctgggcaacagagtgagatactgtttcaaaaaaaaaa

SEQ ID NO: 65383 - DNA, 459 bp, Homo sapiens
ttctaggaagtcagcatggatcaaccttatgttccctgctgccagaccctattctcctacctcaaaatgacaacagattttgaaagagtaacaaaatatgaaagaagttatcagcacaatgtaagcttcccatttttgtggctttgtcctgagggaaggccatgaatatagtataattcggggttgctaaaacttcactgaaaagcacattgcctttctggcctgggaaagacccaggtggcagcagccactgggaattgaaggtgaatctgggagaggagagcgttggagaggaatcaaacttaactcataaagccaataaagcccttgggaaactggcctcctattccatgtacacagtccctgtacagggtttctgatctgtgcaggcgctgccgctaagctcctgaaacagagagtgccgctgggaagaaatcgacctctcccactccagtgctg

SEQ ID NO: 65384 - DNA, 456 bp, Homo sapiens
cagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccgtatgatatgattgcacttagaacacccaatttacttaaatcttggtttacttttgacttgataccataatctttaaaatcatttgtcatctttttttttttttttttgagacggagtctcgctctgtcgcccaggctggatgcactccagcctgggcaaaagagcgaaactccatctcaaataaacaaacaaataaat

SEQ ID NO: 65385 - DNA, 786 bp, Homo sapiens
aagtcttctcccactgatgaggtaaacctcgagaccaatccagaaataaattgccaagcttctatcaaataattcaaaaggagacccaggactcttgatgatacacttgaagtcactaaatatgaaagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaaactctgtattgtaacccgatccccaaggtgattctagtgtacattaaagtgtgagagtcttgttatgaatggattcttatagtgctgcaatttagaacatcttttaagaattataaagacaattttgtgtctcttgtatctgaaataagtattaaaggcaaaatatatattgatatcatggcactgttcttaaggaattaacatccagatgaattattttgcatcttttcattggaaataaaaagcccggggctgggtggcgggcgaaagaatcagagagctctgatcagtgtgtagatgtatcaatatctatttaatatgtactccagcagagagtccaggctttaaatcattggaagcaatctctcaatttttattctcaacatgtttcacctttaggcaatattacaataaaattctctgtgggtttgtaaacttagtgccac

SEQ ID NO: 65386 - DNA, 1759 bp, Homo sapiens
  misc_feature (2)..(3): n is a, c, g, or t
  misc_feature (171)..(171): n is a, c, g, or t
  misc_feature (190)..(190): n is a, c, g, or t
  misc_feature (488)..(488): n is a, c, g, or t
  misc_feature (590)..(590): n is a, c, g, or t
  misc_feature (781)..(781): n is a, c, g, or t
  misc_feature (921)..(921): n is a, c, g, or t
gnntcctaagtataatttttgaaatagcttgataatttcctcaaatgagaaattgatcctagtaagagattgattataactcaactcttacaaaagaaggattaatggaatctatagagaatcacagaaagctaaaactagtcattaaaagcttgcccaaatcaatttcanaattggtacataattatantaataaaaataattttaaaatggcatttattttgaacaatgtataaccattcattctcataatggtgaaaaacggccttaataaaggattaaaagctggagagagacggagggattctcagagcaccagcccaagtgaagattgctgcttactgcaatggaaaagggagacagttagcattgggttaatatttaccatgttttactctctgggataggcattttatttacaatatctcttatgggaatgttttatttatttcattttctctagactgagatccttgcagagaaactgncatgcacaaaaaaatgtcctttgagttaaattggtcactttataagagatccagatttctccccaagtagagaaatttgcgcagaatgtggaagacaaactncccattggaaacacatgcaaaatcactcagtagggatactctcctaccctgggcaagtgaggtcttcttgcagtaaatagtttccactgaggatggacttagaatgaagctaccttgaggggacacgtaggctactagtattcaggaacaacctgccagagacaatgcaggaagtgtgtgtgaaatgaccnaaaagataagagggtagagaaaccctaatggaaggacagatagtgtgaataaaggtagattctgaaaagaatgagctagcacattgtgtaaagatgaggagagaattagggctctggaggagagatctgaggaaaccacncagaatatagcacagagagatacaaagaagaagaatttggatgagtcatgaaaagcttggaggacaggctgagaaggtcccgcagtgtctaactgaattctagaaggaaaggctagggagactggaatagaggccatatgtggaggaatgtgggtgagaacttgctaaactgaggaaaaacactcttccccaggtggaagaggcacactgagttcagagtagtgatggtaaataacaaccacatccaccactagacactctttggtgaactatagggtattaaagacaaagagaaaaattctaaaagcagactgggacaacaaatctgtatttgtagcaggaaaaagcatgaggttcaggttttgactgtactgcttgctgcctgtgtcatcttaagtaggtcacctacctgcttcgagcctcagaggacatctgtcattggctaatgggagtagaagtggctaataacaagaacaatgactaccacacgaggttttgtgagccctgaaatatttccagagaataaatgtaaaagcattttaagtcattaaacaaatgggccgggcatggtggctcacacctgtaatcccagcactttgggaggccaaggcgggtggatcacctgaggtcgggagttcgagaccagtctgaccaacatggagaaaccctgtctctactaaaaatgcaaaattagccgggcatggtggctcatgcctgtaatcccagccactcaggaggctgaggcaggagaatcacctgaatgggaggcagaggttgcagtgagccgagatcgcgccattgcactccaacctgggcaacaaaagcgaaacttcatctc

SEQ ID NO: 65387 - DNA, 408 bp, Homo sapiens
ctctctttctctctctttttcccagagtaaacttcataggaaataagttttcaccatagtgttcacatcccttctcagggtggaagtcacccaccattttaaaaacgagagcaagaagggctggacttggtggctcatgcctgtaattccagcagtttgggaggctgaggcagatggaacacttgagcccaggagttcaagaccagcctgggcaacatagtgagactccccatctctacagaaatttaaaaatgagctgggcatggtggtgtacacctttggtcccagctactcaagaggctgaggcaggaggatcacttgatccctgaagatcaaggctgctgcagtgagctgtgatcgcactactgcactccagcctgggccacagagtgaaccctgtctctaaaa

SEQ ID NO: 65388 - DNA, 3404 bp, Homo sapiens
ggccctgggacctttgcctattttctgattgataggctttgttttgtctttacctccttctttctggggaaaacttcagttttatcgcacgttccccttttccatatcttcatcttccctctacccagattgtgaagatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctatatcagcctatgccagggcttcaatggaatagtatccccttatgtttagttgaaatgtccccttaacttgatataatgtgttatgcttatggcgctgtgacaatctgatttttcatgtcaacttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgacgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatat

SEQ ID NO: 65389 - DNA, 3339 bp, Homo sapiens
agtcgtgctctgtcacccaggctggagtacagtggcgtgatgtgtgcttactgcagcctacacctcccagttcaagtgattctcctgcctcagccttccaagtagctgggattacagattgtgaagatggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctatatcagcctatgccagggcttcaatggaatagtatccccttatgtttagttgaaatgtccccttaacttgatataatgtgttatgcttatggcgctgtgacaatctgatttttcatgtcaacttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgacgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatat

SEQ ID NO: 65390 - DNA, 908 bp, Homo sapiens
  misc_feature (96)..(96): n is a, c, g, or t
  misc_feature (157)..(157): n is a, c, g, or t
  misc_feature (164)..(164): n is a, c, g, or t
  misc_feature (232)..(232): n is a, c, g, or t
  misc_feature (245)..(245): n is a, c, g, or t
  misc_feature (277)..(277): n is a, c, g, or t
  misc_feature (307)..(307): n is a, c, g, or t
  misc_feature (371)..(371): n is a, c, g, or t
  misc_feature (376)..(376): n is a, c, g, or t
cagttattaaacattaccagcacaacattggcttcttattcctcagtttaccaggctgttactcaaaattcactctccagccctgctttggagcanttgggaacttcagcattttgatccacctttttggagccacctcatgtgaaaaatggatganaccttcntcagcaaacctgtctacgtaggagctggtatgaggatcacacaatgcaagcaaataaaatgagaaaanatgattcaacaanaggcttcactgatttactgtttaactgctttnaccaaagtgcttggttcttatatgaataanaaaggggatgagttatccaccagaatgaaagttatattctggtttgaagcttctgctgtcaganaatanagttttctatagtgtggaagaacagcatcatcttcaagcaaggtggaattaagcatgtgacatgaactgtgtttctcacccaggaggaggagtcgtgctctgtcacccaggctggagtacagtggcgtgatgtctgcttactgcagcctacacctcccagttcaagtgattctcctgcctcagccttccaagtagctgggattacaggtatttgctaccaaacctggctaattgtttgtggttttagtagagatgagatttcatcatgttggccaggctagtctcgaactcctggactcaagtgattcgcctacttcagcctcccaaagtgctgggattataggtgtgagccactgtgcccggtcccactgagccaattctcttattgccactttggactcctcccagtgaggacaaatagacactgaggacatcatgatatgcagaaagaaacttggagtgcaagacaagagacctgcacctttctttcagctccgttccaagctgcttgatcacagacatctcttctgtt

SEQ ID NO: 65391 - DNA, 3528 bp, Homo sapiens
atcgaccggatgcccaagacatcaaccggaattaggctcttttgagaagaaaacaaagagagtaaccaaatatagaacagctgagtgcattcaccagtctgggagccctgagagtgctttttctaacaaccacagtgttacatatttccttacaccatgggatgataaaacacaggacacatggctccattcaaggctaactgattgcacaacggctctgagcaggagagagcaaaaggtgaaccacagttgtacagcttgctggtggttggggtcacattggactatcaatatccaggagatgttgagaaaaagaggggatcctttccaacaagtcatccagcaactctgggacagaaggaaagctgtgggaagaaaagcagggtgctggtttctaggacactaaacctcatggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctttgaggggctgatggcaatatctaaaaccaggcaccagcatgaacaccaagctgggggtggacagggcatggattcttcattgcaagtgaaggagcctcccagctcagccacgtgggatgtgacaagaagcagatcctggccctcccgcccccacccctcagggatatttaaaacttattttatataccagttaatcttatttatccttatattttctaaattgcctagccgtcacaccccaagattgccttgagcctactaggcacctttgtgagaaagaaaaaatagatgcctcttcttcaagatgcattgtttctattggtcaggcaattgtcataataaacttatgtcattgaaaacggtacctgactaccatttgctggaaatttgacatgtgtgtggcattatcaaaatgaagaggagcaaggagtgaaggagtggggttatgaatctgccaaaggtggtatgaaccaacccctggaagccaaagcggcctctccaaggttaaattgattgcagtttgcatattgcctaaatttaaactttctcatttggtgggggttcaaaagaagaatcagcttgtgaaaaatcaggacttgaagagagccgtctaagaaataccacgtgctttttttctttaccattttgctttcccagcctccaaacatagttaatagaaatttcccttcaaagaactgtctggggatgtgatgctttgaaaaatctaatcagtgacttaagagagattttcttgtatacagggagagtgagataacttattgtgaagggttagctttactgtacaggatagcagggaactggacatctcagggtaaaagtcagtacggattttaatagcctggggaggaaaacacattctttgccacagacaggcaaagcaacacatgctcatcctcctgcctatgctgagatacgcactcagctccatgtcttgtacacacagaaacattgctggtttcaagaaatgaggtgatcctattatcaaattcaatctgatgtcaaatagcactaagaagttattgtgccttatgaaaaataatgatctctgtctagaaataccatagaccatatatagtctcacattgataattgaaactagaagggtctatatcagcctatgccagggcttcaatggaatagtatccccttatgtttagttgaaatgtccccttaacttgatataatgtgttatgcttatggcgctgtgacaatctgatttttcatgtcaacttccagatgatttgtaacttctctgtgccaaaccttttataaacataaatttttgagatatgtattttaaaattgtagcacatgtttccctgacattttcaatagaggatacaacatcacagaatctttctggatgattctgtgttatcaaggaattgtactgtgctacaattatctctagaatctccagaaaggtggagggctgttcgcccttacactaaatggtctcagttggatttttttttcctgttttctatttcctcttaagtacaccttcaactatattcccatccctctattttaatctgttatgaaggaaggtaaataaaaatgctaaatagaagaaattgtaggtaaggtaagaggaatcaagttctgagtggctgccaaggcactcacagaatcataatcatggctaaatatttatggagggcctactgtggaccaggcactgggctaaatacttacatttacaagaatcattctgagacagatattcaatgatatctggcttcactactcagaagattgtgtgtgtgtttgtgtgtgtgtgtgtgtgtgtatttcactttttgttattgaccatgttctgcaaaattgcagttactcagtgagtgatatccgaaaaagtaaacgtttatgactataggtaatatttaagaaaatgcatggttcatttttaagtttggaatttttatctatatttctcacagatgtgcagtgcacatgcaggcctaagtatatgttgtgtgtgttgtttgtctttgacgtcatggtcccctctcttaggtgctcactcgctttgggtgcacctggcctgctcttcccatgttggcctctgcaaccacacagggatatttctgctatgcaccagcctcactccaccttccttccatcaaaaatatgtgtgtgtgtctcagtccctgtaagtcatgtccttcacagggagaattaacccttcgatatacatggcagagttttgtgggaaaagaattgaatgaaaagtcaggagatcagaattttaaatttgacttagccactaactagccatgtaaccttgggaaagtcatttcccatttctgggtcttgcttttctttctgttaaatgagaggaatgttaaatatctaacagtttagaatcttatgcttacagtgttatctgtgaatgcacatattaaatgtctatgttcttgttgctatgagtcaaggagtgtaaccttctcctttactatgttgaatgtatttttttctggacaagcttacatcttcctcagccatctttgtgagtccttcaagagcagttatcaattgttagttagatattttctatttagagaatgcttaagggattccaatcccgatccaaatcataatttgttcttaagtatactgggcaggtcccctattttaagtcataattttgtatttagtgctttcctggctctcagagagtattaatattgatat

SEQ ID NO: 65392 - DNA, 334 bp, Homo sapiens
ggcatggagcaggcaatgacttgttcatagtcgctgcaattatgagcaccagcttgaacttaggaactcttataaatttctgttttcaaccaagtattgagtgtctgctatgtgtcagacactgcgctaggtgctgaaatctcacttctactgaggaagacaggaacataaatggtgatgatcattgcattagaagtgatgccacgggaatagtgtggggcctctccaggggaatctgaaggtagggagaccacacttctccagtggtggagagggcagacagcgtgtatggggtcctgaaggtctgatgcaaaggtcatgtttgagctgttca

SEQ ID NO: 65393 - DNA, 236 bp, Homo sapiens
catttggacgctggagggtggctagcgtggctggaagcggccagccaggggttcacagaactgaaggtgaggcctccagaggccctagtctctacctgagtgtctctgaaactggggggatggggtggagcctttagggggaagggaagagggaactgaagaggaagtgggggagggaggtagaggaggcaagtctggcgccatgctgagtcaccgcccacaaggcccagggcggg

SEQ ID NO: 65394 - DNA, 1520 bp, Homo sapiens
gcgcgttcgggagcttcggccctgcgtaggaggcgggtgcaggtgtgggtgctgagccgcccgccgcctggagggggagacagcttcaggacacgcaggccgcagcgagggcccgggccctggggatcccaggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggcactgtggctcacgcctgtaatcccagcactttgggagaccgaggcaggtggatcacgaggtcaggagatagagaccatcctggccaacacggtgaaaccctgtctctactaaaaatacaaaaaattagccgggcgtggtggcgggcgcctgtagtcccagctactcgggaggctgatgcagaagaatggcgtgaacccggaaggcagagcttgcagtgagccgagatcacgccactgcactccagcctgggtgacagagcgagactctggctcataaaataataataataataaataaataaaaaataaatgttttcagtaaaa

SEQ ID NO: 65395 - DNA, 1640 bp, Homo sapiens
gcgttcacggagcctgcgggcgctggtccgggcggccaggggtggggggcgcgggcggctgggcccggacttcgactgggggcctggccccggggccacccaggcggaggctctgcggccgcctccaccccggccacatcccgaggccggcgccgggttcggagaactgtcaagggacctccaggcccccacacgcctgcgagatccggcgcttgccttgccccagccacagtttctgtttccgagaaaccggccatggatgctccccactccaaagcagccctggacagcattaacgagctgcccgagaacatcctgctggagctgttcacgcacgtgcccgcccgccagctgctgctgaactgccgcctggtctgcagcctctggcgggacctcatcgacctcatgaccctctggaaacgcaagtgcctgcgagagggcttcatcaccaaggactgggaccagcccgtggccgactggaaaatcttctacttcctacggagcctgcataggaacctcctgcgcaacccgtgtgctgaagaggatatgtttgcatggcaaattgatttcaatggtggggaccgctggaaggtggagagcctccctggagcccacgggacagattttcctgaccccaaagtcaagaagtattttgtcacatcctacgaaatgtgcctcaagtcccagctggtggaccttgtagccgagggctactgggaggagctactagacacattccggccggacatcgtggttaaggactggtttgctgccagagccgactgtggctgcacctaccaactcaaagtgcagctggcctcggctgactacttcgtgttggcctccttcgagcccccacctgtgaccatccaacagtggaacaatgccacatggacagaggtctcctacaccttctcagactacccccggggtgtccgctacatcctcttccagcatgggggcagggacacccagtactgggcaggctggtatgggccccgagtcaccaacagcagcattgtcgtcagccccaagatgaccaggaaccaggcctcctccgaggctcagcctgggcagaagcatggacaggaggaggctgcccaatcgccctaccgagctgttgtccagattttctgacagctgtccatcctgtgtctgggtcagccagaggttcctccaggcaggagctgagcatggggtgggcagtgaggtccctgtaccagcgactcctgccccggttcaaccctaccagcttgtggtaacttactgtcacatagctctgacgttttgttgtaataaatgttttcaggccgggcactgtggctcacgcctgtaatcccagcactttgggagaccgaggcaggtggatcacgaggtcaggagatagagaccatcctggccaacacggtgaaaccctgtctctactaaaaatacaaaaaattagccgggcgtggtggcgggcgcctgtagtcccagctactcgggaggctgatgcagaagaatggcgtgaacccggaaggcagagcttgcagtgagccgagatcacgccactgcactccagcctgggtgacagagcgagactctggctcataaaataataataataataaataaataaaaaataaatgttttcagtaaaa

SEQ ID NO: 65396 - DNA, 1913 bp, Homo sapiens
gttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaaggaaggataggttataaagggaggtacctaaatactcaaataatgtatatattctttttcataacatatggaatgctttaagcaatgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactggccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatctttt

SEQ ID NO: 65397 - DNA, 449 bp, Homo sapiens
gccgagatggccagggagcccgcggaggaggccgcagaggagaagctctcagaggaggccacagaggaaccagacgcagaggaaccggccacagaagaaccgaccgcacagggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaacgtgggaagatttttcaataa

SEQ ID NO: 65398 - DNA, 538 bp, Homo sapiens
accagcacaggctgttgaagcttgagagatttatttaaatcccagaatggcccctcatgtaaaaacaaaagcaacaagcttttctagtgctaggcagacaaggttggtgtgatcatttgactgaaaccttcagttccacaagcaccctgatatccaagctcgtgagttacaaaaggaaaagatgggcttctctacttgtttaagatatagcacacaaatgttgcagatatacacagagctggccattttcttctatttagaaagtcactggtgctggttaatgttgtactattgtttatcatctctcatttcatcccacagtcgggaggaaaagaaagaagactctgttgttcattgtttttatctttttctccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaacgtgggaagatttttcaataa

SEQ ID NO: 65399 - DNA, 2394 bp, Homo sapiens
cggcagaggagctagggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagtggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaacaaaccccttttagcttctcctagcaacatctgtgtcctcagaaacctctggttctcccccttccccctcccccaggctgccctggcacccaaattgctgccatgctggcatctgtagctcggtggcttgacattctccccagggacttcccggttcctagttctttgccagctcctccccactctgtgcgacctttccaagccttccctcaccctccccgccagcaccctctttggggagcaggaacttaatctgctgacagagctacacctttcataacaggctcagatcactcagctccctgtgacctttgtattcacccagggcttccttctcagtagctctagctgggggaggtgtcagctgggcccctcctgtgctatctccccagaggacatccctgactccacccctttcttcctcccaaactctgcacctcttcctcagctgctccagaccggccagggtaaccagctaaccatgcctggcatctggaagccagcaggccagagggtggcccaaaggctgatgaacggtagggaagggtgagcagattcctatgttggtgggcaccaatattccaagggcagctctctttgctgaatgagggccttctcgtgaggtactgacagacagcgtgcagcagaagcctctcgaagctgttgtctagcattgctgtgtacacggcctgggggacacggagaagaaccgaacagccgct

SEQ ID NO: 65400 - DNA, 2422 bp, Homo sapiens
cggcagaggagctagggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagtggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaacaaaccccttttagcttctcctagcaacatctgtgtcctcagaaacctctggttctcccccttccccctcccccaggctgccctggcacccaaattgctgccatgctggcatctgtagctcggtggcttgacattctccccagggacttcccggttcctagttctttgccagctcctccccactctgtgcgacctttccaagccttccctcaccctccccgccagcaccctctttggggagcaggaacttaatctgctgacagagctacacctttcataacaggctcagatcactcagctccctgtgacctttgtattcacccagggcttccttctcagtagctctagctgggggaggtgtcagctgggcccctcctgtgctatctccccagaggacatccctgactccacccctttcttcctcccaaactctgcacctcttcctcagctgctccagaccggccagggtaaccagctaaccatgcctggcatctggaagccagcaggccagagggtggcccaaaggctgatgaacggtagggaaggaaacaagaagagttgggagagggagcttcagtgcatgtggcagtgcgtgtgctggcgcgtatcattgcaccgccccctcccgccctcgccgcaagctggccccggccttgccggcccttcttaggggctttatcatgcctcctgcaagaatagagatcacacacgggacggaaacgttagactctcatcccttgtgcccattcc

SEQ ID NO: 65401 - DNA, 1996 bp, Homo sapiens
cggcagaggagctagggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtaagtattggccacagccccactgattaagggagccacagccagaagtgctcgccctgttcatcatcttcctaaacctgccacaaatctgtgaagtggacagaaaggggagtattaccttacatttcagacagagtccagagcttgcagagtctggcatgcccattgtccgccagctagttcatggtctttgaactccttccagtctagtgctcttcacactacattacctggatccctttgtgcccctccttccttgtcctctgctctggggttggagctctggggcagcaggaataagctcatcccacttctgtccatcacccctagtttgagtctcttccccaaggccaacccatctgttccctgaatcctgttctgggtgctgaggtgtaaggagaaggatgggcttcaaggtgctcgttttcagaaagacagcgggggtgattgggctgatcagagcagagctgtgctggtctgagaaagactcctagaagaagacagtatgaaacaggttcagaatatccactcatgactggtcagggtaaagcttggaaaagggagcagctgggcaaaaggacagtaagaaggaaatgagtatttattaagcactttcacatcatacctaattacatcttcacatacacaatcattcctttgttatattggccccattttacagttggtgacactgaggctcagagaggttaagtgggttgctcaaggctgggtgtggtgtctcacacctgtaatcccagcactttgggaggccaaggtgggtggatcacgaggtcaggagtttgagctcagcctgaccaacatggtgaaaccccatctctactaaaaatacaaaaattagtcaggcatggtggtgtgtgcctgtaatcccagctactcaggaggctgatgcaggagaatcgcttgaacctgggaggcggaggttgcagtgagccaagattgcaccactgcgctccagcctaggcgaca

SEQ ID NO: 65402 - DNA, 550 bp, Homo sapiens
ccaaagggcacctggcctgagctccatcctgtgctcagggggtagacgagggccccaatgggctgaagctcatctcggaagtgattggggagcgcctcggcatccccatgagtgtgctgatgggggccaacattgccagcgaggtggctgatgagaagttctgtgagacaaccattggtgagagccccctggcacctgcatacacagtgcatctagttgcatcccctccccaaactgccccaaccccacttagccatctctttcccataaggcagagaaaggaaaatacaagcatcagaggtgaaggaggctgggacacccccagggaaggggcttcagggcctgcttagggaaacacagtgatgagccctccctcagagttggtgcagtggcacacctgtggtcccagctacttaagaggctgaggtgggaggatcgcttaagcccaggagtttgagtccagcctgggcaacagagagagactcccatctctataaaataaatattttttaaaaagagtccttccctcaaagccttgccccctcctcac

SEQ ID NO: 65403 - DNA, 2898 bp, Homo sapiens
cggcagaggagctagggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagtggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaacaaaccccttttagcttctcctagcaacatctgtgtcctcagaaacctctggttctcccccttccccctcccccaggctgccctggcacccaaattgctgccatgctggcatctgtagctcggtggcttgacattctccccagggacttcccggttcctagttctttgccagctcctccccactctgtgcgacctttccaagccttccctcaccctccccgccagcaccctctttggggagcaggaacttaatctgctgacagagctacacctttcataacaggctcagatcactcagctccctgtgacctttgtattcacccagggcttccttctcagtagctctagctgggggaggtgtcagctgggcccctcctgtgctatctccccagaggacatccctgactccacccctttcttcctcccaaactctgcacctcttcctcagctgctccagaccggccagggtaaccagctaaccatgcctggcatctggaagccagcaggccagagggtggcccaaaggctgatgaacggtagggaagggtgagcagattcctatgttggtgggcaccaatattccaagggcagctctctttgctgaatgagggccttctcgtgaggtactgacaacaccagcaactcgagagctgggaaactcaaggaggaggaagaaaatcaaaaccaccctactccctggggtgaggaaagaacaggaggggaggaggaggagtgtgctctgcacttgccttgctccaggatggggtggcagcagaggaatgtcacaggtcagcagcctaggcctccagctataaatagtccggagggcccgagaggctcccgcccgtccagcagggctgtcagcttcctgtgtggcagcacctggcacactggctctggccagcattatgctaaaaccctgttactctccaatgaaccagggaggcgggctcctctctgcgcctatcccttgagaattctgtcttaccagtgaagggtggggctgcccagatcaggcagcaggagtgaggggcacagtcaccccaggccttgctgagcccaggtctgggtactgagtgtccagagctgcctccccaggaggttaaggtgggggcaaaggggaagcttcaagcactttgcctacttttgttcactccccagtgcactgtgactcaggccttcccatcaggcctatttgtctacccaataaagcgtgttttttccag

SEQ ID NO: 65404 - DNA, 2664 bp, Homo sapiens
cggcagaggagctagggagtgtggcactgagccggctcaggcagagacgcggcaccatggctagcaagaaagtctgcattgtaggctccgggaactggggctcagccatcgccaagatcgtgggtggcaatgcagcccagctggcacagtttgacccacgggtgaccatgtgggtatttgaggaagacattggaggcaaaaagctgactgagatcatcaacacgcagcatgagaatgtcaaatacctgccagggcacaagttgcccccaaatgtggtggctgtcccagatgtggtccaggctgcagaggatgctgacatcctgatctttgtggtgccccatcagttcatcggcaagatctgtgaccagctcaagggccatctgaaggcaaacgccactggcatatctcttattaagggggtagacgagggccccaatgggctgaagctcatctcggaagtgattggggagcgcctcggcatccccatgagtgtgctgatgggggccaacattgccagcgaggtggctgatgagaagttctgtgagacaaccattggctgcaaggacccggcccagggacaactcctgaaagagctgatgcagacaccaaacttccgtatcacagtggtgcaagaggtggacacagtagagatctgtggagccttaaagtccattgagcagctggagaaagagttgctgaatgggcagaaactgcaggggcccgagacagcccgggagctatacagcatcctccagcacaagggcctggtagacaagtttcccttgttcatggctgtgtacaaggtgtgctacgagggccagccagtgggtgaattcatccactgcctgcagaatcatccagaacatatgtgagtggggccagggcccaggccaggccgcttttttaccccagtggagaccagcagaagcctggggtacctagtcaccaggatctccaggactcccagggagcagagtcttctcatcttttcactggaggacaggaggctatggggcccagctacgcacctggagatcctgaactgtcaagccactggcagcctcatgccaccacatttgccagaaatgcagttgccctgtccctctccagatgtggggctttctccatatcctctgggaggggtggaatcaagccccagtgctgcctgcttggtggcgggggtgatgtatgtggagaagggttgggggagaggccggtagggcaggggctgctagtggctgtctcacatacaccagtaatcctgttaaagggctgaagaagtatcttagccacaggagcgatgaggcaaggattgtcagggaggggtctgggcttctgagctgatgcaggccccaaggacccctttgctgacctctgccaggacccacacagcttcgatggatctcagtgtttgttaacaaaatacaaagatctcaaacaaaccccttttagcttctcctagcaacatctgtgtcctcagaaacctctggttctcccccttccccctcccccaggctgccctggcacccaaattgctgccatgctggcatctgtagctcggtggcttgacattctccccagggacttcccggttcctagttctttgccagctcctccccactctgtgcgacctttccaagccttccctcaccctccccgccagcaccctctttggggagcaggaacttaatctgctgacagagctacacctttcataacaggctcagatcactcagctccctgtgacctttgtattcacccagggcttccttctcagtagctctagctgggggaggtgtcagctgggcccctcctgtgctatctccccagaggacatccctgactccacccctttcttcctcccaaactctgcacctcttcctcagctgctccagaccggccagggtaaccagctaaccatgcctggcatctggaagccagcaggccagagggtggcccaaaggctgatgaacggtagggaagggtgagcagattcctatgttggtgggcaccaatattccaagggcagctctctttgctgaatgagggccttctcgtgaggtactgacaacaccagcaactcgagagctgggaaactcaaggaggaggaagaaaatcaaaaccaccctactccctggggtgaggaaagaacaggaggggaggaggaggagtgtgctctgcacttgccttgctccaggatggggtggcagcagaggaatgtcacaggtcagcagcctaggcctccagctataaatagtccggagggcccgagaggctcccgcccgtccagcagggctgtcagcttcctgtgtggcagcacctggcacactggctctggccagcattatgctaaaaccctgttactctccaatgaaccagggaggcgggctcctctctgcgcctatcccttgagaattctgtcttaccagtgaagggtggggctgcccagatcaggcagcaggagtgaggggcacagtcaccccaggccttgctgagcccaggtctgggtactgagtgtccagagctgcctccccaggaggttaaggtgggggcaaaggggaagcttcaagcactttgcctacttttgttcactccccagtgcactgtgactcaggccttcccatcaggcctatttgtctacccaataaagcgtgttttttccag

SEQ ID NO: 65405 - DNA, 472 bp, Homo sapiens
tactgaagctaaatacaatttatttcatgctgggggacagaaaggagcaagggagagcagtcacctgctccttatctgggctattttcttagcagacctcaaaatgagaccatggtgggaagctgggctggggccaagggaagaagcttgccagcactgtcagccgatgagcccaggagaaaaagctgggcctagtctctgccccattcctgttccacacctgtctgtacccctgtctctcctttccctggctctgccagactctctatctccctgggcgccagcctccccacccacccctggagggcggggcttggctgcacccacgtgtggtggagttaaatgctcctagccggcagaggagctagggagtgtggcactgagccggctcaggcagagacgcggcaccatggctagcaagaaagtctgcattgtaggctccgggaactggtaagcagctctgtcaagtgat

SEQ ID NO: 65406 - DNA, 163 bp, Homo sapiens
gaacaccacagacccatccactacccattcagaatttatatagaatatgtgcccatgattatctaggtgaatcaatgcaacagtagctctgatgtccagatttcctagtctattattttgtgtacagatcctctaaccacttagaaataatttttaaaatata

SEQ ID NO: 65407 - DNA, 457 bp, Homo sapiens
agataggatagaatagatgaaataaatcttactttcattgggcctgaaaggatagagaaaatttggatcatttagaatgaaggaaacatcccagcaaatggaagcagagacaaggggagtataaactgcattctaggtccaagaggagacaggaccaaccgaagtgaaggattttataggccagctctacgtaagactggaaagttaagcctatagtccatcctggcagttaaaaatgcagcaaagtgctgggattacaggtgtgagccaataaatgctttttactagaaaaggcaagaacctggataagacctctctggataaatcatcaaaccttttgcaagtggctactcttaccttgttgaagtatttccatcccttctccaggtgagcagaaatccccggatgccatttgattttcttgggattctaatctgtggaaccaagaagtgaaaga

SEQ ID NO: 65408 - DNA, 456 bp, Homo sapiens
cgtgtctttaatagtttgctaattagactagctggttagaaagagggatcactagattggagagagagatccagtttccactggaggcagtaggtctgctcatttccatggtgacaatcctaatggcagagggagtgagtttcccttagtggcacaggctgggggttttgagcttttaagttttgttttatagaaatctggagaattttacattttacttcactatatatctatgtttaaaataattcatttttgatgtcccaaaattgatgtgggttgccttatttccaggcaccaggttgctcactgcaaggtgacattttgagaagcagaaatctctaggtatatcttaagtgtgaaaagcttgttagatttccatggcctattccaggtgggttgttgggtttatgttgtaagcatcaaacttttgtggaaataaatacctaatacaaggta

SEQ ID NO: 65409 - DNA, 456 bp, Homo sapiens
cccatccagagcctttgctgctgtgtcactcttctaagcctggttcttgcccagtggaacccaaccatggaaccaaaagaagcatgtgtctggggtcaccggagccgttgttctctacctgcccagtgcgctattcagaagcagaggggctggggcagaaggtctggagggagtgggttatgaagcccctcagtgagccttgggattgtttgagttctcaaagacaagtgctggaacagtgattgtgtcaccccagtgctgctgtggcccacagaacatctgtgacacagaaacatcagccagagtgcagcatgaatacagatggcacctctgggggtcaggaccacgtaagtgacaatttgctgaacctctctttctatgcaggttagaggacggaggctggataactttgtggaaagttcctctgtggaacatttttatcttggccaagttgca

SEQ ID NO: 65410 - DNA, 522 bp, Homo sapiens
tgagggtggagggagttgtaagccctttacaatcccattagtgacctggtgcacaggcaaaacatcttgtttggagaaaatggcttcatcttgatgccttgcaaagctttaggttacctcctctgccataggcaggcgtccaacaaggtagttacataagaagaagatatatcaactgattaagagagcctactgtctgtgttccactttctaatacgtatgcaacctaaaatttaatctgatctctctcccagtataactgtaggtattattttgccaaagctaaaatcacattagataaatgaattttctttcatatatcattttcaatcattgttatctacatgtataaaaagtaaatccagggatgtatagttttggcaacatgtcaagagtatggaagacagccaggtgcagtggctcatgcctgtaatcctagcacttcgggaggcctaggtgggaggatcacttgaggccaggagttcgaaaccagcatggccaacatggtgaaacactgtctct

SEQ ID NO: 65411 - DNA, 718 bp, Homo sapiens
caaaaataaatttgtaatatttgctaatttccatggtgtaaatactcccacggtggccaattttaagctaacaatgtgacatcacctaacatggtgcactgtagcactgttacatagtatttgtaccataaagatacaataaatctcaagatcataaatggtagtacaacatagtaaaataatcaggaagtgatgagtttttagtaattattacctgtatctttattataacttcattgtaatattgatttaaattacgactgtgtttaacaaatggcttgcaaattttaatgatcacctctcaccattacctgaaaacattcttgaaaaagacacacatccctcctttggcctgtggactaatcagagcacatgagcaatctcagagaacctgccatgtgtcaagtgaggaaggagaagtgttaggggaggcattgtttacggatggatttggccagtaatcaacaatcaggaagagctattattgtgttcattccctggggcctatgtggccacacagaaccaagtaggcaacttagcctcctcattcagaggcttgccctagagcctgagctaagaaaaaagaccacggggaatgcactgcagcccacaggcaaactgccttctgcatcttatacatactctagcccaggatttcttcagcacagacgacctgcatgaagttgtgcttaaaatgtaatgtcttggccagacgtgg

SEQ ID NO: 65412 - DNA, 257 bp, Homo sapiens
gctggctttcttgtgcgcatgcagactctgagctgatcatgtcacttctgtgggcatggttgttctccgtatggcataggggcaaatgcacagtggatttttgaagatgaaattaggtttaatgaaggcggaagtgttttgtaggccggcaagtgtgaaacaactgtgtgtgttttgtatgctttcatgtgatggccagtcaggtgtggccacagaagagacacaatttattatagtcataggtcgtagagacagga

SEQ ID NO: 65413 - DNA, 258 bp, Homo sapiens
gtcttggtatgttgtccaggctgatctggaacttccggcctcaagtactcttcccgtgtcagcctcttaaagccttgggattacaggcatgagccactgcacccatccaggacctggatattttcggaggctattattcatcccaccataatggccaatgattatctttaagggaagacactgcaaatgaagattccaaaagaactggaatcctgggtaaagaatcttctagaacatctgaactcatatgtgttcaat

SEQ ID NO: 65414 - DNA, 392 bp, Homo sapiens
tgagccaccgtgcccagcctgagactactttttgatggagcccactcaaggggatgaggaggtttgaaccacaagtggctggctaaataaaagcttagtcagagctgggcacggtggctcacacctgtaatctcatcctccctagtagtggggattacaggcgcccgtcaccacatctagctaatttttgtatttttagtagagatggggtttcaccatgttggccagtctggtgtcgaactcctgagctcaggtgattcacttgccttggcctcccaaagtcctgggattacaggcgtgagccaccgtgcccaggtgcccccaccttttttttttttttgaggcagagtctcactccagcctggacaacaagagcaaaactccatttcaaa

SEQ ID NO: 65415 - DNA, 287 bp, Homo sapiens
cttccgacactttgagtaccttttaatatgtttactccataaaacttactattaataataatatccactatatatttgtgaaattgtttagagtattaactctatctacacaacccaatgaggtagaacaatacagatcacatgttacagaaaaggcaaccacatctcaaagaaataaagggcttcttcgcagccattcagatagtaacagtgtcagaacaagagagctgagggcttctggctctcaggttcatggtctttccattcaacctgcaatctctctattg

SEQ ID NO: 65416 - DNA, 6746 bp, Homo sapiens
  misc_feature (3308)..(3308): n is a, c, g, or t
  misc_feature (3314)..(3314): n is a, c, g, or t
gattgattgcgtcgtggagagacagtgtgtggatgagggagggtcacagcacatgctcagtcctgtcagagtgaggggaagtttctgcgttctgcgtgaaggcttaggtcatagcacaagctcagtgaaagctctatgaggtctctgagactgcatgtgcctccattttgagttgttagtgtagaaaagggcagagttttagcagaaagtaaaggttcaggaatccagctagactcaccagagcccgtgttagtcatggatgatccattcagcccctgcaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65417 - DNA, 720 bp, Homo sapiens
ggaacaaggggcccttcaatgggcaaggggcttgttttccccgtggggcttcttgaaagggaggggcttctttccctggttggggctccccaagaacttcctgcaataccagggcccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65418 - DNA, 457 bp, Homo sapiens
cggccgctcaggcctccttttgttttagcaagtgcacttcactccccgggcccccacctgcccgcctgcgccgcccctttccgcgggtccggagttggcggggccctgcgccggaggaggaggaccaggcccgcgggctcagctctcgccgccagcgggccgcagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacttgggaaggacaaagaagagaaaagaatcagtgtaacatttaaacaacagtgcaaccgtgctgtgagagccatctcaacctgatgtcctaagtagccagtgtttccttccctcgtgcc

SEQ ID NO: 65419 - DNA, 544 bp, Homo sapiens
gattgattgcgtcgtggagagacagtgtgtggatgagggagggtcacagcacatgctcagtcctgtcagagtgaggggaagtttctgcgttctgcgtgaaggcttaggtcatagcacaagctcagtgaaagctctatgaggtctctgagactgcatgtgcctccattttgagttgttagtgtagaaaagggcagagttttagcagaaagtaaaggttcaggaatccagctagactcaccagagcccgtgttagtcatggatgatccattcagcccctgcaggccaaacttccagatctgcaaccatttccttctccagatggtgatacagtgacccaacatgaggaactggtctggatgcctggagttaacgactgtgacctccttatgtacttgagggcagcaaggtaataggaatctacccccatcctgctttctgaattagaccatctgaactgattataggcagtaaactttgcatttcccctgagattttatttctatattgggcgttctctgactttaagtttggttacaccctctgt

SEQ ID NO: 65420 - DNA, 6286 bp, Homo sapiens
  misc_feature (2848)..(2848): n is a, c, g, or t
  misc_feature (2854)..(2854): n is a, c, g, or t
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65421 - DNA, 7870 bp, Homo sapiens
  misc_feature (4432)..(4432): n is a, c, g, or t
  misc_feature (4438)..(4438): n is a, c, g, or t
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactgagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65422 - DNA, 7692 bp, Homo sapiens
  misc_feature (4254)..(4254): n is a, c, g, or t
  misc_feature (4260)..(4260): n is a, c, g, or t
cggccgctcaggcctccttttgttttagcaagtgcacttcactccccgggcccccacctgcccgcctgcgccgcccctttccgcgggtccggagttggcggggccctgcgccggaggaggaggaccaggcccgcgggctcagctctcgccgccagcgggccgcagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65423 - DNA, 6917 bp, Homo sapiens
  misc_feature (3479)..(3479): n is a, c, g, or t
  misc_feature (3485)..(3485): n is a, c, g, or t
gattgattgcgtcgtggagagacagtgtgtggatgagggagggtcacagcacatgctcagtcctgtcagagtgaggggaagtttctgcgttctgcgtgaaggcttaggtcatagcacaagctcagtgaaagctctatgaggtctctgagactgcatgtgcctccattttgagttgttagtgtagaaaagggcagagttttagcagaaagtaaaggttcaggaatccagctagactcaccagagcccgtgttagtcatggatgatccattcagcccctgcagtctagagggcaagacagccattcaaagaaataactacaaaaaataaatataaaatcctgactgtgatatgggtggaaggagaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65424 - DNA, 6369 bp, Homo sapiens
  misc_feature (2931)..(2931): n is a, c, g, or t
  misc_feature (2937)..(2937): n is a, c, g, or t
caggcccgctggctttcgtgttcccggtgggcttctgtgatactggtgccttccggtgcctcctggcaaattctttggattaaggaaagcggccttttaaccccctagggttcccttctggagaagagtcaccgggtttggttctgtttcccctttctgctcgacacttctgggaagcttggttctcagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65425 - DNA, 6513 bp, Homo sapiens
  misc_feature (3075)..(3075): n is a, c, g, or t
  misc_feature (3081)..(3081): n is a, c, g, or t
tctcaaacacagggagtgggagggaccctctgcccggtgggcaggtgatttattggctgggaagcttccgcggtgatttagttgtgaagcggcggccggggaagtgcaggctaatgcctgggccgccagggagaggccgcccacaatcgcgggccggaagggaccgcggggggcgtcggggccagccccccgtttcgcagctgaggcggggttggggcggagggcgtgcggccggggcgcagccgacttcgtccatccggaacgtgggctggagacccagcagcctgggaagggccccagccctgtgggcgccctctccccacgcttgctgcgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65426 - DNA, 6268 bp, Homo sapiens
  misc_feature (2848)..(2848): n is a, c, g, or t
  misc_feature (2854)..(2854): n is a, c, g, or t
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65427 - DNA, 6109 bp, Homo sapiens
  misc_feature (2848)..(2848): n is a, c, g, or t
  misc_feature (2854)..(2854): n is a, c, g, or t
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgtcgagggttttttagatggaacaatctcagcgttcgccttgggatatgggggtctacgc

SEQ ID NO: 65428 - DNA, 5703 bp, Homo sapiens
  misc_feature (2848)..(2848): n is a, c, g, or t
  misc_feature (2854)..(2854): n is a, c, g, or t
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccactctgcctcctccggtaccgac

SEQ ID NO: 65429 - DNA, 6238 bp, Homo sapiens
  misc_feature (4558)..(4558): n is a, c, g, or t
  misc_feature (4564)..(4564): n is a, c, g, or t
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaattcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65430 - DNA, 2157 bp, Homo sapiens
gcataagaaatgtgtaacgggggatgtagtgaaagagggttgctcgaataggttggcgccgttcagaatctatggatagtttgcccccaggcgtgaggggagtgcgccaatttggcggatccagggtatgtttgagtaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65431 - DNA, 1713 bp, Homo sapiens
cacgcgtcgccacgcgtcgccacgcgtcggaccacgcgtcgttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65432 - DNA, 1749 bp, Homo sapiens
ggatgaatgtcttttttaatactccagaacaatcaagtgtgtgtacacagaaatctagaaggaaatctacaatggacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65433 - DNA, 1211 bp, Homo sapiens
caccacataaaacacccaacagacactcaacagctaggacaggctggtgtaatcggccaggcttgtggccttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65434 - DNA, 470 bp, Homo sapiens
ctgcgcggtgatctagaggatccctcacgttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65435 - DNA, 2630 bp, Homo sapiens
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaaggtcaggtgctggggggatagtagggcctactctgtccctccctcacattaaaactggtttgctggtattcgtgatcagctccctcagacacgaggatgcagctcattcatggagc

SEQ ID NO: 65436 - DNA, 2176 bp, Homo sapiens
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccagtaagtggcctcgtcacgctcct

SEQ ID NO: 65437 - DNA, 1443 bp, Homo sapiens
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtaggggtaaggagaatcccgtttttaaaagctatcagtattttatatcccatagggtataaaataggaatattacctccctccccagagccccttttaaaatgtgctgtattatatgtgtttttaaaggagtaacaagtacatgcacagaggaagcaaaatacgggacttgccttacccctctaggacagttccagaagttagcggggtttggtggaagggtattttggcaccagcagagagcatgctgggctgctgcaaggagcaggagctggcaatcagcagcgagtatggatgttggcaactgaaatggg

SEQ ID NO: 65438 - DNA, 884 bp, Homo sapiens
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaaggaggtgattgtctaggagtaactgtatgtgcgctcagcaccgggtcacaaccaccgtgggatccacttacagagaagatttgtggagagcttcagcctgtttatggtgttactgagaaaggaattgtggccatttgatataattctggatggaagacctcttatttgtattacattgaattagaggtcagtatttgaaattttctccttgagtggctattataagaggatcccgtaagaattgattactgtgaaattagccaactacatagtgtatttcaaagataaggtaaactgttggacttgtgattacctggtttctggtatgaattactgaacttatgtttgtttttatgtgcatagataaagctatatgcttgatactctttcaattataaacttaatgggttataaga

SEQ ID NO: 65439 - DNA, 155 bp, Homo sapiens
tgttgctaaagcaccaaagagagaggagtttgactattttgagcttgtctgtgacacctgttttgtttggaaaatgctaatgaaactagttggcagagctgcatttttgaagttgtttcatttagtcacagtgatagtcatctgtcttcttttag

SEQ ID NO: 65440 - DNA, 424 bp, Homo sapiens
gccagctctctgctgtcgcggggaggaaagggcagccaacccaggaagtggcatgagggactgccagtgaggttcctggcctgctgggctcactcacccatgccccccagctgtcactcccagacacaaccctcacacgtagacaacccatgcatgagcttagtctcacagggacacattcccatctgggcctgaggggagctgcgggcacaggtgagcccgaccctgtggggcctggactgcatcctggtgtcaggccaaggcagggccgggtctccgtggagggaccaggttggcctgtcagagcaggccaggagcaggaccaggcccacctccgcagtgtggaccaagcggagaccccaggcgctcgggggacccctcacgctttcttttccttctgcagaaggcgtccagctcagcgcat

SEQ ID NO: 65441 - DNA, 810 bp, Homo sapiens
tctctaggttttaatttccaagtaactttatttgttgcacattgcaggagaagaaaaatgtttattggccagaagctgtattccaaagacatgtcaaatattccacattttagctttaaacagttaaactttctgcctatcataatatagtaggaagaaaggctcatttttttttatgatttagaaaggctttaaactgagtttttcttatattcacaatggttttaatttttctccatttctactttgtttaatattctttctcatagtcctgtctccagtttatctttgttgttttaattaattttactttattagtaaaatggtgatataaaagcagtcagattacacaggtgtacagtgaagcagtcatgaaacagctgaataggtgaaataaagtgtggtgtttgtagccgattctccatgcacatggacttagttcagtgcttcctccacccttccccctccagttttggttagcaaaagcagttgagggtattactaattatttttttctctttttcccagagggaagtgtaacatctcccatttttctgacatatttgctgctagagagtttaaagcccgagtggattcatttttctacatattaggatataaccctgagacaaggtaagtgagtcacttgtgtccattcattgagaactcttttccttttctcatttgtgtgtgtgtgtatgtgtgtgtgtgtgtagtttatgcttctggacatacactagtaacatacttaaaaaaaatgactccagagtccttcagtaaacttctttgggaggagttgtaattaatgtc

SEQ ID NO: 65442 - DNA, 8181 bp, Homo sapiens
  misc_feature (4743)..(4743): n is a, c, g, or t
  misc_feature (4749)..(4749): n is a, c, g, or t
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaaggaggtgattgtctaggagtaactgtatgtgcgctcagcaccgggtcacaaccaccgtgggatccacttacagagaagatttgtggagagcttcagcctgtttatggtgttactgagaaaggaattgtggccatttgatataattctggatggaagacctcttatttgtattacattgaattagagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65443 - DNA, 522 bp, Homo sapiens
tctcaaacacagggagtgggagggaccctctgcccggtgggcaggtgatttattggctgggaagcttccgcggtgatttagttgtgaagcggcggccggggaagtgcaggctaatgcctgggccgccagggagaggccgcccacaatcgcgggccggaagggaccgcggggggcgtcggggccagccccccgtttcgcagctgaggcggggttggggcggagggcgtgcggccggggcgcagccgacttcgtccatccggaacgtgggctggagacccagcagcctgggaagggccccagccctgtgggcgccctctccccacgcttgctgcggtagggaggaagtttctgtgctttaccgccttgatgttctcctgtccggaaggaggacacagattccagcgccgggtgccctggaggctccggcctcggggtgggggtcgggccgggggcggggccggggccggggcgcggggccccggctggcggacaggagggcggcggcaatccaggccgcctttt

SEQ ID NO: 65444 - DNA, 7996 bp, Homo sapiens
  misc_feature (4558)..(4558): n is a, c, g, or t
  misc_feature (4564)..(4564): n is a, c, g, or t
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65445 - DNA, 6921 bp, Homo sapiens
  misc_feature (3483)..(3483): n is a, c, g, or t
  misc_feature (3489)..(3489): n is a, c, g, or t
ctgtgaatcagcgtggctgagaaggctgcaagagtgggaagaagtcaaggaacctcacagagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65446 - DNA, 6367 bp, Homo sapiens
  misc_feature (2929)..(2929): n is a, c, g, or t
  misc_feature (2935)..(2935): n is a, c, g, or t
gagccggagcccagtgacaggcgacggcctcttgccgccccggaccccgggcgcttacctgtggctgctggggtcggccgcccgggaccaggctgggagccccgagggttcccttctggagaagagtcaccgggtttggttctgtttcccctttctgctcgacacttctgggaagcttggttctcagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65447 - DNA, 5947 bp, Homo sapiens
  misc_feature (2848)..(2848): n is a, c, g, or t
  misc_feature (2854)..(2854): n is a, c, g, or t
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgtttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65448 - DNA, 8268 bp, Homo sapiens
  misc_feature (4830)..(4830): n is a, c, g, or t
  misc_feature (4836)..(4836): n is a, c, g, or t
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggtgaggtttgctgctgagccttgctgagtaaagctaatgcttcttcagaagcccccagccggggttctccctagttggtggccgtgccctgtctcctagggtggggctggagtggcctttgacactggctgggtcagggcacgacctgtggtcccggagccaagcttgctgcttcatctgcacaaacattactgtgtgtccggcactggtggtgcagagcagacagggctctgccctcctgggacttccatccttcccttctctgactccaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65449 - DNA, 6040 bp, Homo sapiens
  misc_feature (2602)..(2602): n is a, c, g, or t
  misc_feature (2608)..(2608): n is a, c, g, or t
tgtgcacgttcagtatagatgtaaccatcacagtcctgcctacattttcagtccatggttgcttgaatctgaggatgcaaacccacaggtgcagagggctggctctcattcccacccccagatacgtgttccttcttggccccagttgacccttctagagctttttgctcctggagatggaactcagaatgagggagcaaagtgtctgcaaaccgtcatttccttgctgaggctgatgggatggtctcccttggcctgattgctccttgtgggcttttcccctgcagaaggtgaaggaggaagcctcttcccctcttaagagtaacaaacgccagcgggagaaggtggcctctgatacggaggaggctgacaggaccagctccaagaagacaaaaacgcaggtgaggtttgctgctgagccttgctgagtaaagctaatgcttcttcagaagcccccagccggggttctccctagttggtggccgtgccctgtctcctagggtggggctggagtggcctttgacactggctgggtcagggcacgacctgtggtcccggagccaagcttgctgcttcatctgcacaaacattactgtgtgtccggcactggtggtgcagagcagacagggctctgccctcctgggacttccatccttcccttctctgactccaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctctggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactaca

SEQ ID NO: 65450 - DNA, 5167 bp, Homo sapiens
  misc_feature (2848)..(2848): n is a, c, g, or t
  misc_feature (2854)..(2854): n is a, c, g, or t
gagccggagcccagtgacaggcgacggcctcttgccgccccggaccccgggcgcttacctgtggctgctggggtcggccgcccgggaccaggctgggagccccgagaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggccctagggtaaaatacaggctgcccccaacacctgtcttaactccaggatctcccttgctcaaaagtggcctcaatctgtggcagaaagatgggccgtcctcaccacagatccagtgacatgcgcatgagaagcagccttca

SEQ ID NO: 65451 - DNA, 5886 bp, Homo sapiens
  misc_feature (4558)..(4558): n is a, c, g, or t
  misc_feature (4564)..(4564): n is a, c, g, or t
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccgcaggctcccacagcgcctgttccccacacccacatccaacaggcaccggccttgcacccccagcggccgccctcaccgcatcccccgccgcatccctcgccacatcccccactgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgngagcgngagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccata

SEQ ID NO: 65452 - DNA, 2711 bp, Homo sapiens
gcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcggtgagtcccctggggccatggggctcctggcaacttcttcagtttcctgggatgtgtgggggcttgagcctcccagggggaggaagcgaaagtcttgtttaccagacaaagtcctggaggggagctgctttgcccgaggcggtagcttgcctgtgggctgggaagagttctctgttctctccttcgaggggccccagggtggcatcctgctctgggttttgtagcaagctcttagcttctggctcagtgcaggctctccaaggcccctcttgctctccaaggctgctgcttgtggtgtcacttccattgtatcaaatctctgctattttaaacttgcaggctcttttgtgttagtgtg

SEQ ID NO: 65453 - DNA, 1072 bp, Homo sapiens
gagcggggtcgcgcgcgcgcggcaggcgagtagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctc

SEQ ID NO: 65454 - DNA, 766 bp, Homo sapiens
gagcggggtcgcgcgcgcgcggcaggcgagtagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccagaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggac

SEQ ID NO: 65455 - DNA, 571 bp, Homo sapiens
cactgaccttcgggaagcaggctggagagggggctggaaataaagctctataaaaactcatgaacagtgggtcttgatgagcttccgggtttatggattcgtgggctgcttccacctgctaggagggtggtgtactctaactcagggacagaagcccctgtctgtgctcaggactcttgcagacctctttacctggctgttcatcttccataatcaactggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtaagtctgtatactaagtgatcttttggatttttacctagaatatgatgaatctgcatgttttaggaataattaggacagaggaattcttagccttgtcattactaagtatcttctaat

SEQ ID NO: 65456 - DNA, 482 bp, Homo sapiens
gctcggtacccggtgtttatcgatgccaccctccccgaccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggac

SEQ ID NO: 65457 - DNA, 736 bp, Homo sapiens
gtaccccatcgagcacggcatcgtcaccaactgggacgacatggagaaaatctggcaccacaccttctacaatgagctgcgtgtggctcccgaggagcaccccgtgctgctggccgcccgcccccttgtcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctc

SEQ ID NO: 65458 - DNA, 968 bp, Homo sapiens
cactgaccttcgggaagcaggctggagagggggctggaaataaagctctataaaaactcatgaacagtgggtcttgatgagcttccgggtttatggattcgtgggctgcttccacctgctaggagggtggtgtactctaactcagggacagaagcccctgtctgtgctcaggactcttgcagacctctttacctggctgttcatcttccataatcaactggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctc

SEQ ID NO: 65459 - DNA, 868 bp, Homo sapiens
  misc_feature (605)..(605): n is a, c, g, or t
  misc_feature (611)..(611): n is a, c, g, or t
  misc_feature (618)..(619): n is a, c, g, or t
  misc_feature (637)..(637): n is a, c, g, or t
ttaaacgtcgcttcccgccccgcctgggtctcttacgcttttttagcgggcaacacagcctattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaagnccttgnctctganncctcttaagtctaagatnaaatgcccccttcgttgctcctccctcctgacaaagaaataaactccgccatcgcttgggcccacaacgcggacctcttcgacgctcccccccctagggaggggtacactctcgtccctccatccttgactccgttctcctagaatatacccacttcgcctaccgcgcgcgcttcatacgctgggcggtctagacgattttctccaaaatactgggcgatacacgaggata

SEQ ID NO: 65460 - DNA, 578 bp, Homo sapiens
ataaatacaattaattttataacatgccttgagataaaataaaaaagctgattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgccataaaaaaagaaataaattggatctcttgtcctcattt

SEQ ID NO: 65461 - DNA, 1125 bp, Homo sapiens
  misc_feature (49)..(49): n is a, c, g, or t
  misc_feature (64)..(64): n is a, c, g, or t
  misc_feature (1125)..(1125): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaacggactcattggcctaaatgtccccccccctcgccacggcaaacatagcaaaaaaatgtccctcttggcccccggggggacctttgcgcacccttcccttcacggagggtcaacttaagaccccccctcaccacctccctgccttccgactcctggcatn

SEQ ID NO: 65462 - DNA, 1247 bp, Homo sapiens
  misc_feature (43)..(43): n is a, c, g, or t
  misc_feature (123)..(123): n is a, c, g, or t
  misc_feature (141)..(141): n is a, c, g, or t
  misc_feature (181)..(181): n is a, c, g, or t
  misc_feature (183)..(183): n is a, c, g, or t
  misc_feature (185)..(185): n is a, c, g, or t
  misc_feature (368)..(368): n is a, c, g, or t
  misc_feature (1247)..(1247): n is a, c, g, or t
agaggcaggtcaatgtgtacaagaaaacaaaaatctttccacntcagcagcagagtgagttttgtaaagccttctgcttcattttccacaacacctgtgccaaagtaactgagaaaagcagcnatatactctcttcttttntaatacccttaaatcacgtactgcaccttgttggtgagcngntngcatacttgaggaacgtaatcaatgaaacatcctcctcctggaaaagctgggatatgaagagctgaggagcctccaagtgcatgctcaattcgaggtgacaagtacagcttggggtacacctaggtggcttcagtgtcctcaaaactgacagagaggagggccacatcttctccagggtcttnatttacatccttgagtaggtttgtggggatattgctgaaatctacgggcagcttcaaaaggaaacgagctgaaaattcaccagtccagttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaacggactcattggcctaaatgtccccccccctcgccacggcaaacatagcaaaaaaatgtccctcttggcccccggggggacctttgcgcacccttcccttcacggagggtcaacttaagaccccccctcaccacctccctgccttccgactcctggcatn

SEQ ID NO: 65463 - DNA, 830 bp, Homo sapiens
  misc_feature (830)..(830): n is a, c, g, or t
aatataattaatattttattactttatcaataataattaataattataaagtaacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaacggactcattggcctaaatgtccccccccctcgccacggcaaacatagcaaaaaaatgtccctcttggcccccggggggacctttgcgcacccttcccttcacggagggtcaacttaagaccccccctcaccacctccctgccttccgactcctggcatn

SEQ ID NO: 65464 - DNA, 824 bp, Homo sapiens
  misc_feature (824)..(824): n is a, c, g, or t
gcactgtaattcggattgcgcattatggcaagaaaacacaaaaacctaagttgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaacggactcattggcctaaatgtccccccccctcgccacggcaaacatagcaaaaaaatgtccctcttggcccccggggggacctttgcgcacccttcccttcacggagggtcaacttaagaccccccctcaccacctccctgccttccgactcctggcatn

SEQ ID NO: 65465 - DNA, 816 bp, Homo sapiens
  misc_feature (816)..(816): n is a, c, g, or t
atatttaatcatataataaaaaaaaagacaaaaaaaccttagttgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaacggactcattggcctaaatgtccccccccctcgccacggcaaacatagcaaaaaaatgtccctcttggcccccggggggacctttgcgcacccttcccttcacggagggtcaacttaagaccccccctcaccacctccctgccttccgactcctggcatn

SEQ ID NO: 65466 - DNA, 1028 bp, Homo sapiens
  misc_feature (49)..(49): n is a, c, g, or t
  misc_feature (64)..(64): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctga

SEQ ID NO: 65467 - DNA, 1130 bp, Homo sapiens
  misc_feature (49)..(49): n is a, c, g, or t
  misc_feature (64)..(64): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctga

SEQ ID NO: 65468 - DNA, 732 bp, Homo sapiens
ttatgtattaaaaatatatatcgcttcatatataagtaaagattaacatatttgtttgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctga

SEQ ID NO: 65469 - DNA, 729 bp, Homo sapiens
atataaataaaaaccgttatgatattaagatttcctgatttataataagtgattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctga

SEQ ID NO: 65470 - DNA, 719 bp, Homo sapiens
atatttaatcatataataaaaaaaaagacaaaaaaaccttagttgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctga

SEQ ID NO: 65471 - DNA, 1098 bp, Homo sapiens
  misc_feature (49)..(49): n is a, c, g, or t
  misc_feature (64)..(64): n is a, c, g, or t
  misc_feature (1098)..(1098): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaacggactcattggcctaaatgtccccccccctcgccacggcaaacatagcaaaaaaatgtccctcttggcccccggggggacctttgcgcacccttcccttcacggagggtcaacttaagaccccccctcaccacctccctgccttccgactcctggcatn

SEQ ID NO: 65472 - DNA, 839 bp, Homo sapiens
  misc_feature (16)..(16): n is a, c, g, or t
  misc_feature (20)..(20): n is a, c, g, or t
  misc_feature (839)..(839): n is a, c, g, or t
cactccccaccccccncccnctccccccccctatgtttagggtgcacgccaagggcagcagtatcatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaaaaaaacggactcattggcctaaatgtccccccccctcgccacggcaaacatagcaaaaaaatgtccctcttggcccccggggggacctttgcgcacccttcccttcacggagggtcaacttaagaccccccctcaccacctccctgccttccgactcctggcatn

SEQ ID NO: 65473 - DNA, 955 bp, Homo sapiens
  misc_feature (49)..(49): n is a, c, g, or t
  misc_feature (64)..(64): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctga

SEQ ID NO: 65474 - DNA, 1157 bp, Homo sapiens
  misc_feature (49)..(49): n is a, c, g, or t
  misc_feature (64)..(64): n is a, c, g, or t
  misc_feature (894)..(894): n is a, c, g, or t
  misc_feature (900)..(900): n is a, c, g, or t
  misc_feature (907)..(908): n is a, c, g, or t
  misc_feature (926)..(926): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaagnccttgnctctganncctcttaagtctaagatnaaatgcccccttcgttgctcctccctcctgacaaagaaataaactccgccatcgcttgggcccacaacgcggacctcttcgacgctcccccccctagggaggggtacactctcgtccctccatccttgactccgttctcctagaatatacccacttcgcctaccgcgcgcgcttcatacgctgggcggtctagacgattttctccaaaatactgggcgatacacgaggata

SEQ ID NO: 65475 - DNA, 1176 bp, Homo sapiens
  misc_feature (49)..(49): n is a, c, g, or t
  misc_feature (64)..(64): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagccagctggccctcccttctcctcctccttctcatctgctgcaccaggggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctga

SEQ ID NO: 65476 - DNA, 639 bp, Homo sapiens
  misc_feature (49)..(49): n is a, c, g, or t
  misc_feature (64)..(64): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggtaagtgaatctgtcgttatttccaacaggtaagagcattttgtttatctagtccaggggttggcaagctactgcttgcaggttagttcctgccctgtgcatgtttttgtaaataaagttttatagaaacaca

SEQ ID NO: 65477 - DNA, 324 bp, Homo sapiens
  misc_feature (49)..(49): n is a, c, g, or t
  misc_feature (64)..(64): n is a, c, g, or t
gaccctggagaagatgtggccctccccttgttagttttgaggacactgnagccacccaggtgtnccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaacttaaacagtttttgttgtcttggatagctgctgtagaaggggatcctctagtc

SEQ ID NO: 65478 - DNA, 568 bp, Homo sapiens
ggaggagaaagaaacagctctctgggccaggacccgctgttcgtgggatgtctggggagctgtgtgaacccacaggccgttttgtttctctccatcagcagctgtgggctgaagcgtgtaccggcagagtgggttgagatcgtgtctgcgcccacttgccaccagctccggcctctggggaggtggtgctgagagggagggagagtggctcctgtttggctcctggagacagacagctgggtgtcccaccctcagagtccccagccccctctcccctctgctaactctgccggtggagctcacgccgcagctcatgccaaccctgcccttctgttttgcctctcatgactctccccaaattctgccccaggcccccagccagccttcttgccactttcctgccctttactcttgccccttctacctcttgccagggcagcgtcactggctacgtgaggcccagcttggggatgcatggggaggtgtaagaacagctgtgccatgagctgtccttccgggcctctggggctggagaaaccccggggtcagcagtaccacgggttttgct

SEQ ID NO: 65479 - DNA, 1108 bp, Homo sapiens
gatgaatcttaaagcaacactccattggaggagctgctcccttccccgttcagctgtaattgtctgaatatttatttctcggcattcactgcagaacaagctgcaagtggtgactcggacgtgatcaagtggtgactcggacatgatcaagtggtgactccgacgtgattgccttgaagttatgcatggagtaggatgactcaccaatcttcggggaataccggactagagtggatccccataaaatgagtgaagccataatatgagttagagactactgaaaaagcccctcctgatgatgaaggacctgtcattggagaatcgaccaaaactgacagtgataacttggaaggcacctgacattacctggggacagctaaagaaactggaccaacagggaactatctggcttgcatctatgggagcccctgaaactgcagagaaccagtttcttatgtatctgatggtaattgggggagcttctgagaaggcatctgcaaatggctctgtgctgccactcaaccaactatgaccagggaagaatgatagaagcttactttgcattggataatccgcatgttctaagaattaaagaagggggaaatgtgaggggtgtatgacaatacattcaagcttatgtacaaggcatttgaggttgaggcatggaaaaatactgaggcactgtgtgtatgttgtttgtgcatgaaactgtaattccttgaccctgaaaataggacaaggaatagaatttgtaataaggagtgctgaacacagcctcctaagaatgtggtttgagtgcttttagatgttataaacaaggccatatgtgcctcatgacccgaccccaaatagccaccttgtagatgtttcttgtttgtctaaattgtagttcaactagccttctcaataaatacttggcagatgaatcttaaagcagcactgtcttggaggagctgctcccctccctttcagctgtaattgtctgaatacttatttcttggtgttcactgcagagcaagctgcagcacagctgccggcatttattcatgcaagattccagcttgcttatctatgtctgcagctcaattttacaggctgctctttgtta

SEQ ID NO: 65480 - DNA, 377 bp, Homo sapiens
tacagattagaaaattaaggttcaggtcaattaaagatgtggagctttgcttctccatgggagaaaatttggcctagttttagatggacataccttatgccttttagagcacaaacccaagatactaaactgtctctggatttaagtgtaagaccaaaagattgtctagaaaagtttgagggcagtgtgtatttggattggcacatgcatcctttgagcctaaatataagaagagaatccagagaaatatcatcattcctgtcaaggaaaaaagtgagcactaacaggagtggtggtaagaggcccataggagaaggcataagagtcagaggggagaaggagaaaaggtaggcaaagcccaggtggagagcctgggg

SEQ ID NO: 65481 - DNA, 444 bp, Homo sapiens
ggttttcaccatgttggccaggctgtgaactcctgacctcaagtgatccacccgttctccctggcctccctaagtgctgagattacaggtgtgagccaccatgcctggccctgtttttcagttttcctgtttttcaattttagctgttgtctgttggctttcttctgtggtagatgagtctatgctttaggattcttatgccaccttgaaatttctttcccatgtcttcccaatatagtcatgcttttgattaaatcagcattcgttgtttacattattatgagtttgtaaatatgtttacagtggaaccttacagtgtactatgattatatttcttggagttgatttctttttatttcttagtttcctatttgtctctaatttttttttctacaaactgtcccaatatcatcaaacatcaggtaattgacccttcagttttaa

SEQ ID NO: 65482 - DNA, 298 bp, Homo sapiens
ggagtttcaccatgttgcccaggctggtctcaaactcctgagctcaggcaatccacccacctcggcctcccaaagtgctaggattacaggtgtgagccaccgcacccggctgggatttttatttatgtccatctgtaatgtacgctccccacagaaatcccagcatctaaaaccaccaccttgcacattgcaggggctcccaaaaacctcttgggtgaagggatggataggctggtgcccagaaacaacacatctttaggggatccatggcacggtcaaccctcacactgagggttga

SEQ ID NO: 65483 - DNA, 351 bp, Homo sapiens
tgtattgctaactgtctttgtaactaatttatgtatactgtaaatggtatagcatgtgattttattatagttgattaactttgtaatttctgtaactgcatcgatatcccagtctacctggaaaattaagtctattaaccatagttgctgtaggagacagtactattgccaactgaagcctgaatccttcatttattttgtccccaattacagagtggaggtttagaggagtggggttagataatgctcagattagaaatacaaaggcagctgtcagatcctcccattttattgttgaagaaactgagttgtaaacatcacaagagctagttaactggtgagtagcagccc

SEQ ID NO: 65484 - DNA, 180 bp, Homo sapiens
ttccttcctttactcatgtccacaaaggatcttggcgactgatacattctgatgtctagtgatttttgtactagccaagtaataatgtttttaaaaagactatgagaaaaagaattcaactgaaaatttatgatagctttaaaaaattaaaagctaacagatacatttttaagggagaga

SEQ ID NO: 65485 - DNA, 126 bp, Homo sapiens
cacaaaaaacaaaaacagagaagggtttgactctttaaacgatgtgtgtgcaaaatggaaactaaatgtttttctatgagacaagaaagaacaagcacatgcacacatacagacacacagacagac

SEQ ID NO: 65486 - DNA, 382 bp, Homo sapiens
gaatgtgtaccacagcaggtactgcatgctaaacccacgacttatgaccctattgtccaaatgagtggcaagcataacttctccattgtggtggtgaatgagaggatgaagagataatgatggcatatagaaagaaaagtgcagcaaacaaaaggataaccctgaagaaaaacttgagctgtttctctgctttgtctaatctcctgtcaggacatcatttattacccacaatattcacttgagaaaacaactttgagaaaccagcaaagaaaaagccaaaggatgaagatgaagtccttctatagttcaaatcgctcatgtctgtgatcttcaaaatgtgacattggacaatcaatttaaatgctcttttttaaaagataga

SEQ ID NO: 65487 - DNA, 748 bp, Homo sapiens
gtaggccctacgagagactgctggcttggggcgcagcccgtacctctgggagaggccacaaaggggtcggagagcgcggtcctgtgcacagttagggttaagtccgctcagtctccattgggccctgatcctgaagttctgtgccctccgaagaaagggcctattcacgtttcctggagacgccggaggtgcccagcttgtgctcaccactcaagcagctctccccttgctggaggtgtgggttggagaattgcagaatttccctctcggcccgaatgagccattaccaaagcattttgtcaaaaatagtgaagttagtttggccttccaaggttaggtggtgtggtagattgcgggaccgaggttcagaatttctgggggctgtatccccgagccccactcctcagaatgcaactctgtacgacgaaggaactgggtaatccgcatttcagccaatttagcagatgactaaccaccttaaaacggtccacacaattatcttgtttatcaggcaaaaaaattgactcctaggtaccgaattggcatggatttgacaattagcgattcacggttaagcagactttatctatcttaatccaatcaaaggagaatttctgcctgctgtgtttggagagacaacgcgtggatgtgagttaaactttgttaaacccaggacaagctttaagataaaacgactgatatttaaaatggcaatttaaataaaaatgttctctgatcagcctttttg

SEQ ID NO: 65488 - DNA, 465 bp, Homo sapiens
ggaactgggtaatccgcatttccttcgtcgtacagagttgcattctgaggagtggggctcggggatacagcccccagaaattctgaacctcggtcccgcaatctaccacaccacctaaccttggaatgcaactctgtacgacgaaggaactgggtaatccgcatttcagccaatttagcagatgactaaccaccttaaaacggtccacacaattatcttgtttatcaggcaaaaaaattgactcctaggtaccgaattggcatggatttgacaattagcgattcacggttaagcagactttatctatcttaatccaatcaaaggagaatttctgcctgctgtgtttggagagacaacgcgtggatgtgagttaaactttgttaaacccaggacaagctttaagataaaacgactgatatttaaaatggcaatttaaataaaaatgttctctgatcagcctttttg

SEQ ID NO: 65489 - DNA, 2311 bp, Homo sapiens
  misc_feature (1)..(3): n is a, c, g, or t
  misc_feature (72)..(72): n is a, c, g, or t
  misc_feature (671)..(671): n is a, c, g, or t
  misc_feature (964)..(964): n is a, c, g, or t
  misc_feature (1021)..(1021): n is a, c, g, or t
  misc_feature (1109)..(1109): n is a, c, g, or t
  misc_feature (1292)..(1292): n is a, c, g, or t
  misc_feature (1442)..(1442): n is a, c, g, or t
  misc_feature (1947)..(1947): n is a, c, g, or t
  misc_feature (2077)..(2077): n is a, c, g, or t
nnngaggtgaaaattaaaaaatctagtatactgcttagtgtggctttaaaatcaatgtatttgtttttgaanttttttagtgtgatttcatagggaatactagaaataaaacatctgtcaaggaatgaattttttgcagatgagtagtgtcagagaggcatgaaattgattgctgtgatctaaggagaatgcgctgtggagcaggcatggtgggtgctgatgttgtctgttggtctctctgtgtatgccaaggtgactttcaacagaaagatgagcttggtctaggggataaggccccttcaactcttggtatttcttttgaggttgtaaggagttgaggtaaaaaatatagggccatctttattcagaagtaagactgttggaaattgttttctaaggcctatgtttaactagctaataataacaattgttgtgattgtgttcaatgatataaaatttgattcttaagaggcgatttatccttttgctggagtgggtttcaagtagtttttcagaataaaattagttttgcagcatatattcctttggagaggggttgttctgttttctcatataacttcattagactcctagctttcaaaaacggatatcactcttccctcagattggctgacctttacagcaattggcggtgtctttctctaacatcntagaataggtgctggccatgaagtttaatcttgaacttacttctgtgtaatgtttactcaaagccatgctctgaaatataggcaatccatttatttcttgattgtctaagacctgtcttttcattatgtttgattattattagtgagctacaaaactggaccatgttgttctgtctctctatatcaaatttctcttatttgattgttttggtgttcacagttttcatcctacatatatagaaagacttcatatagtacttacagtgagtgggggagggggctatgttaaaccncaaggtgtctttttagaaaaatgtagcctatagtgaaaagatggtacaaggaaattntttccataggaactaatgtacagtgccccagattgccctatcttgcactttttacttattaactctgccctaaaattctttaagtaancctttaatgttaaaacattaagatgaaatagacattttaaaaatggagaggattctgggagttggagacttgaagcatctctgcaccttctgctatcaatttcagtctcgccactagttgctgtttctcagaagcacatctgacgacagatgtgagccattgggctagttctggcaaagtgcngggatcaacagtgttggccccagtctctgtgactgttcctgagataaccttttggttttcatgtccctgtcaactggtttgggtgggtgagggatggggagagactttctccaggttttcttaagagggggctgcaaactcatcagctgntggcataccactgggcctcagcagcagaggctgcctcatctcccaccacttagtggatccttccacttaaggcagcccaacagtgggacctgagctctggtgcgtaggcagatgaaaaagaaggggtcatctatggggcacagtaggcggagagaaagagacaaatgagaacttagaagaggtgtgtcttggaagaactcttggaatagttcagtggtgctttgatgtttgtagcattgacaacgattactacttgattttaatacaccctcaattttaagttgcattttgatttcatagatagtgaagagtagaagaaagtaacttcatgcatgttatatttgatgaattagactaaattccagaaggagataaagggaagagtttgagaggaggtgataattatgtgatataaaacatttcactgagctgaagaaaactggagtctgcaaattgaaaggactctttattctaggaggcactgatgagaaaacatgcacacctngtcatagacagctaaaatttcagaactctaaggataaagagaaagccttatgaacttccagatagaaagaacactaatttataaaggaaatgggatcagcctgggtttaggcttttcttctgccagactngaagctagaagatggaatgacacctaaaaggactgcaagcccacaattctctgttgagctcttactcagctgttacggtgaaaaagaggaccattgatatgcaaggatttagaaaatttattaattttaattctagcaggcagagtccattaaggagatcaaacacaccagttatttttatagagagaatttaatgtaagaattgttaatgaggcacttaagagctgaaaaggc

SEQ ID NO: 65490 - DNA, 370 bp, Homo sapiens
atgtatctttttactgacaaactgacatcaagatcaaatttagtggccctctcttctaagaccacccagtttgagattaaaggcatcttccaacactttagattggtttcctgttagacttataggtatttccttagcatggttttgtatcataaccacagcattcagcattacacagctggttaattatcaaattactcccaggatgaggcccaaattttattttatttttatttttgtttttttgtaccttacttctataatagcttggctccaggcataacataatgggataaaataagacagactaacatgtgaaaatgttaaatgtataagataatttatgaggaaaattatcattaacataaaa

SEQ ID NO: 65491 - DNA, 463 bp, Homo sapiens
aaccacatggagggcttaatgtatgtcccctgcaatgtgggggacgtgatagaatggtgtctgatttatctgagaagcctaaaggtaagagatgggtttactaagcatttaataaataaatacaaaaataaattatctgtgttgacattggcctgcatcccatgagtaggcagcagaaaaataaatatgcatgcgtttcccatgggtcagtcataagcacatgtgacagagagccagtgtggtctgccttcacgcctgtactgaaattgccacttgtaatggtgactcattaggcagtgaccagccagattaaagcggcatttgtctacatcaagtaaattgcagtaggtactgcttcagttaattcacaaatgcccaggagatccaaaggcagctttaaacatctgtgagccccagaacgtgtggagcttccataggacaagcacagtaacataagaaaaat

SEQ ID NO: 65492 - DNA, 1693 bp, Homo sapiens
  misc_feature (3)..(3): n is a, c, g, or t
  misc_feature (5)..(6): n is a, c, g, or t
  misc_feature (10)..(10): n is a, c, g, or t
  misc_feature (15)..(15): n is a, c, g, or t
  misc_feature (20)..(20): n is a, c, g, or t
  misc_feature (164)..(164): n is a, c, g, or t
acngnncgcngcctnttttnttttgccgggagcatagtgctgctgcacgctccactctgttggaattcatttctttgctcagtggctcacctgctggagcggaagcgccctggacacaggggttttgtctctgtcccttgctgcatcccatgatatcatttctngaatagtgaactaattagtaaatgcaatggtattcggtggtgatatgaagtagaatttttaacgttccactatgctagttttgctttgttttctagattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaagagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcggtggcccagccccttctctccctgcaggtgacccgcgccgcccccgcccgcccgcccacgctgtcctccacttaggcgcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgct

SEQ ID NO: 65493 - DNA, 299 bp, Homo sapiens
gagttgaaaactttgaggcatatctatttgtactgtcatgaaaacatcatgagggcatattaagtagaagaaggatgttgtagcatgatgtatactgtttgattgcatgtgtttttaagcagcaaaattgaaactatctatgtaaaaacacataaaaagttctggaagttataggtctttttgaaaacagtgattacctcctaggcgggttctagatgggagcgaggaggagccaaggagaactttaggcttatctgtatttttttaaatttatgtatttttctctaattaagaataaa

SEQ ID NO: 65494 - DNA, 396 bp, Homo sapiens
tctctgaatgagacttagacataaattattgtaccttcatatacatatataatgttcattatctttttaaaaatcaataggggcccacattttttagtttttgaaaaatgggtagaagaaggaaggagggagaaaattgctgctgatctataggaaagaatagcagggtatatcttggtttaaactgaactatgtacagtttctcgtgtttttcacttttcacatggtccaatatgaaaaatacacctaaaacaatcataataattatgtaccaagtaccaacatgtaccaggcaattttacttttgctatctttaattatcacaacaatattgcagtgtaggtaagttccctttaagactgaaggatgctgagtcctaagagtatcagtgacctc

SEQ ID NO: 65495 - DNA, 436 bp, Homo sapiens
ctaaagcacaacttttcgccccgaggcctgttgttgcacttaggaggggacttcagcatcatgcttagggctcatttgaaacaatgtgctcaccaaggaaaagcacaacagttgaactaactatgccacgtaaggacacttgtttgcagtgccagagccacgacaagaaggcagggcgttgcctcgttcaatcttagctgagaacgtgtgtgctgggcagctctgcacatgtctgcaaatgactgagaaaggaccacaagtatcaactctggggtaatcaatacattttagtgagaaggcaaattcacaaatatggaatctgccaacgaggatcgactgtattttacagaggcatctggtgaccaaagtcagaccaatccttggtattaacagaactatctcttttccaccaatccagtaaaaacaacaagacaac

SEQ ID NO: 65496 - DNA, 526 bp, Homo sapiens
acttctcttcagcttcaggccttagctgaattgtcgcctcttgtccctcttcccatagcgtccttcgctcccgcaatggggtcctagtcacattgcatgtgagttgctgctcatgcctgtctcctgcatgggactgagccctgtgggtgcaggaaccacatggctcctctgttattccccagcgccttactggggcacctgatgtgtgtgggcagtcaccaaacagtggcaggtattgaccaaggtgtaggttcccggcaggctgaactgcccctgggaggttgagggatcaatcaccaaaccccaggagggaagggaggagagtgaggaggaaagtcaggacttgtcttcggtggtcggtctgcctctcctcacaccttctccagtgattcagagagtagatttgggggactgagaagatacacaaaggacagaaactcatgcttcagagatgctgatgtcatataagtagtttccctgtctggccttggatgtttatatacatatgtgttggtaaaaagtgtta

SEQ ID NO: 65497 - DNA, 238 bp, Homo sapiens
tttagttccctgtttgttgttgttgttgttgttgttgttattgttcttcctcttcctgaatggcaaagcatttttgagggggcttcctactattgattggtaaggacatgagagctagagctctttttttgtttatttttcttttccctgagatggagtcttggtctgtcgcccaggctggagtgcagtggtgcaatcttggctcactgcaacctccaccttccgagttcaagtaatt

SEQ ID NO: 65498 - DNA, 728 bp, Homo sapiens
ttacagctgtgagccaacatgcccggccatcacaggctattttttaatacccaccctaaaataggctatggagccatagttgaagtcttggtttgttccactgtgtatctgaaggagttagatagaagcatcccttctaattctgaaattgagggaaatcttgttgtctatgtgtgtatcaacctctctttttattaagattttgaaatatgttggtatcacagatataaaacattctcatgttctttaaagagaattcacttttatgctagaaatgatggaaagggcttggtccatgacactttgctgagttattttgcttcatctgcatattactttgggaagaagatacaacatggtaaaataacagttttgaagaagaaaaaaataataatgactgttctaataacaagtcaagtttttcttttgtttggttggtttcagtcttttcatgggtttaaaaatataatgcagacttaatgtctttttttccttcatcaggagaaaatcctaattccagttgtacctttcccccttttcttcaggccatccagtgaagagagagagactgaaatatctctgaaggattctacactagataactaggttgacatacctggaatatagagaacacttgagaagtttgtaatggttttcatttgaaatagactgctgaaagttttaaatttttataagcatagttgatgacgtgacactcaggatcctcg

SEQ ID NO: 65499 - DNA, 963 bp, Homo sapiens
ttcggtctagtacgaggcgggtgtgaattcggccgaggcagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatggtgtcgactctttgccttttggggcacaatgggtcttgaccagcgctctgtgtgaccttggggggtgggcccctggataacgggtgccctccgaaaggcgttctgcggtagaggcgttaatggggggaaccccgcgggacgcctttccccccttgggcggccg

SEQ ID NO: 65500 - DNA, 400 bp, Homo sapiens
ttagcccttccaggcctaatgaaatggttgttagatgatcttcaatgtcccagccaccctttaaaattcacaattcaaatttatccacccctataattcagaattctagtgtagaaaaagtagttttataaatttaaatagacagacttcctggtgtaccagcaaccatgacttacatttgatctgacagtggaaatgcatttttctcactttataatgttgagacacaatgtttttaatttcagaactctacagagcaaaacagatttccccaatgctttcagttaaacgtgcttgtaacttttagtttaacaagtcgccaggattctcccgaatcaacgacgtcgtaacgagcgtcctagttgcctacgctttaggatgtcagttagactctagatga

SEQ ID NO: 65501 - DNA, 340 bp, Homo sapiens
cgcagtcttctcccatcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgatgggagcaagatggcacagtctaacaaaacaacgtagggatacaaccaaagaataaggctatttaaggtgacacgcaggaagcaacctgggagcaggctgatgcactagagac

SEQ ID NO: 65502 - DNA, 3363 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaaaaaaaaaagtcgacgcggccgcgaatttagtagtagta

SEQ ID NO: 65503 - DNA, 3296 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagtgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 65504 - DNA, 3473 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaactctgctagtaaattactttcttgctatttacaagagtaagtgatggaattctgggtttgctgccaaggaaataatttcttagttaactggtcacagaggttgtgctgttttgggaaacggggtaactaaacagtaagctcaagatga

SEQ ID NO: 65505 - DNA, 3097 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatgagaagtatcctaagttcagagccagg

SEQ ID NO: 65506 - DNA, 2957 bp, Homo sapiens
tggctatttggttatgcggttcccttggactcccctgtgtgatagagcccccgtttgggctctcggacccccccctggaatttgttcacaggacgcctctggtgtccccccgcgcgtttttttatgggggggaatccccgcgccttgttctctggccccggttttctcctttgggcccgcgtgtggcgccgcgtcgcccgtacccatactggggcccccggcccccaccagaaggtgttaagaaaagtttttccgagggcccaaggccggcgccaaaagtgtgtttcttcttctttcttttgcctcttgttttacccggctcttttcttggcttatcttcttggatctgcccatcttctatcttctaatttataccaaaaggatgttctgtgacagaattccttttatgattggatagtgaagacactctttttactttgttttagatttgcctttaaattaaaaattatagcttactgatatctaaaatactattatagttgaatgacaagtatacattgttatgttctctaaaatagcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 65507 - DNA, 3289 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaagttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 65508 - DNA, 2060 bp, Homo sapiens
ttacagctgtgagccaacatgcccggccatcacaggctattttttaatacccaccctaaaataggctatggagccatagttgaagtcttggtttgttccactgtgtatctgaaggagttagatagaagcatcccttctaattctgaaattgagggaaatcttgttgtctatgtgtgtatcaacctctctttttattaagattttgaaatatgttggtatcacagatataaaacattctcatgttctttaaagagaattcacttttatgctagaaatgatggaaagggcttggtccatgacactttgctgagttattttgcttcatctgcatattactttgggaagaagatacaacatggtaaaataacagttttgaagaagaaaaaaataataatgactgttctaataacaagtcaagtttttcttttgtttggttggtttcagtcttttcatgggtttaaaaatataatgcagacttaatgtctttttttccttcatcaggagaaaatcctaattccagttgtacctttcccccttttcttcaggccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 65509 - DNA, 2415 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttatggggagaaaaaggtcattatacacaggctcactctcttttattgagtaatttaactcccaggtactggcgtcacttacttcttttgac

SEQ ID NO: 65510 - DNA, 3623 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggttacagatgttaggtcaagatgaggtctgcatctaatcctgtataagagcagagatttttcatagggtgctgtgagggctttgctaactctattttgtccgattggccagaaaaaggatgctctaatggaaatagcaaacctgtatcattaaactctttagaaacaaagaaactggtttaataggcagaaatgtgtttatgtttgtgtcgtgtaattctgcaacacaatgttagagatgactgacctttctcctagtaaaactagaatgtctaattgtccttaaatggtactgatgcctgaagaatgtttaaagaaatagctattgcttctctagtaacttctgtgcatgtgtatccactattatataaaagtcaaattcaactaccaagcaggttgacatgttcatgacaacattttcagttgcctatcttcattagctaatgtgttacatgtaatttgacaggcgtgttacatttgattgaaataagcataaagaaaagctgcctcgaaaaaagagaaaagctgtcttaaatcaggggttttatagctccagaaatatacaaagttaggaatttcttttgacttgaacttggtgggatacctgtataactgatacataacacacgggcaaactgtgggagtaacctggttgattaacttttctcctcagtttcaccagggaacaataataggtacctgagtctttgatgaaaaacttaaccttaagaactagcaaaataacattctcaaataattaataaagaatcccagtagcagaaatgttttaactggcatgtttcttctttgtccgctaaaatgtattgacaccacacatggaataatgcattatgacaataattaactttttgaagtttggtgttttgagagtatgaaatgaatgaataagataaaatatccttgcatatgcatgtaagacctataaggaacgcagtattgaaaataaaggaatcaaaatttttacccatggaattttagggttgggtaaatcattcatttatcttaaatctatggtttgctggcagttatcaatctgctcaattttagcattgttgtatacaagaaagtaaaaatttaggtataacataagccagcctcttaagttctctatagtgattatctgtgtactgactgaatcagtgaatgagaacactagacataccagaaactcgtgcttgtcatctccaagccaatggacttaactgtttgtggcatttaagtccataaaacatacttcactgtcaaacacataggcttataggtttcgtcagttttccatgtgtaagataaatgtctgttcttagccatccagatattcagtcaaatttaaatacaaccttggagagagaaagtggaatttatttattttaaatgatgcatttgaaatctatagtattcctaaaagtcttctaaacagtattaaatgttctacccataaaggttcccagaaaatatttgagtaaatctatctgatggtctagacctgaaaataaagaaagtttattttgctgggcgctgtggttcatgcctgtaatcgcagcactctgggaggccaaggcggatggatcacttgaggtcaggagttcgagactattctgcgcaacatagtgaaaccctgtatctacaagaaataaaaaaattagcccgccatggtggcctgtgccccatgtttctcagctactcggtaggctgaggtgggaggatcacctgagcctaggg

SEQ ID NO: 65511 - DNA, 3614 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggttacagatgttaggtcaagatgaggtctgcatctaatcctgtataagagcagagatttttcatagggtgctgtgagggctttgctaactctattttgtccgattggccagaaaaaggatgctctaatggaaatagcaaacctgtatcattaaactctttagaaacaaagaaactggtttaataggcagaaatgtgtttatgtttgtgtcgtgtaattctgcaacacaatgttagagatgactgacctttctcctagtaaaactagaatgtctaattgtccttaaatggtactgatgcctgaagaatgtttaaagaaatagctattgcttctctagtaacttctgtgcatgtgtatccactattatataaaagtcaaattcaactaccaagcaggttgacatgttcatgacaacattttcagttgcctatcttcattagctaatgtgttacatgtaatttgacaggcgtgttacatttgattgaaataagcataaagaaaagctgcctcgaaaaaagagaaaagctgtcttaaatcaggggttttatagctccagaaatatacaaagttaggaatttcttttgacttgaacttggtgggatacctgtataactgatacataacacacgggcaaactgtgggagtaacctggttgattaacttttctcctcagtttcaccagggaacaataataggtacctgagtctttgatgaaaaacttaaccttaagaactagcaaaataacattctcaaataattaataaagaatcccagtagcagaaatgttttaactggcatgtttcttctttgtccgctaaaatgtattgacaccacacatggaataatgcattatgacaataattaactttttgaagtttggtgttttgagagtatgaaatgaatgaataagataaaatatccttgcatatgcatgtaagacctataaggaacgcagtattgaaaataaaggaatcaaaatttttacccatggaattttagggttgggtaaatcattcatttatcttaaatctatggtttgctggcagttatcaatctgctcaattttagcattgttgtatacaagaaagtaaaaatttaggtataacataagccagcctcttaagttctctatagtgattatctgtgtactgactgaatcagtgaatgagaacactagacataccagaaactcgtgcttgtcatctccaagccaatggacttaactgtttgtggcatttaagtccataaaacatacttcactgtcaaacacataggcttataggtttcgtcagttttccatgtgtaagataaatgtctgttcttagccatccagatattcagtcaaatttaaatacaaccttggagagagaaagtggaatttatttattttaaatgatgcatttgaaatctatagtattcctaaaagtcttctaaacagtattaaatgttctacccataaaggttcccagaaaatatttgagtaaatctatctgatggtagaaccgactattctctagttttagctaagatacacctggaacactgacaagtcatcacttacatagaataatgtgaagtaaattttttgaaaaataaattttagtggaacaatcctgaaggataacaccagaagaatagcaggttaccagtaaggtgtcagccaatttgttccagtcacttttgaatccatgttctataatctaaaattacctctctgcctaagctgagagc

SEQ ID NO: 65512 - DNA, 2358 bp, Homo sapiens
ttacagctgtgagccaacatgcccggccatcacaggctattttttaatacccaccctaaaataggctatggagccatagttgaagtcttggtttgttccactgtgtatctgaaggagttagatagaagcatcccttctaattctgaaattgagggaaatcttgttgtctatgtgtgtatcaacctctctttttattaagattttgaaatatgttggtatcacagatataaaacattctcatgttctttaaagagaattcacttttatgctagaaatgatggaaagggcttggtccatgacactttgctgagttattttgcttcatctgcatattactttgggaagaagatacaacatggtaaaataacagttttgaagaagaaaaaaataataatgactgttctaataacaagtcaagtttttcttttgtttggttggtttcagtcttttcatgggtttaaaaatataatgcagacttaatgtctttttttccttcatcaggagaaaatcctaattccagttgtacctttcccccttttcttcaggccatccagtgaagagagagagactgaaatatctctgaaggattctacactagataactaggttgacatacctggttacagatgttaggtcaagatgaggtctgcatctaatcctgtataagagcagagatttttcatagggtgctgtgagggctttgctaactctattttgtccgattggccagaaaaaggatgctctaatggaaatagcaaacctgtatcattaaactctttagaaacaaagaaactggtttaataggcagaaatgtgtttatgtttgtgtcgtgtaattctgcaacacaatgttagagatgactgacctttctcctagtaaaactagaatgtctaattgtccttaaatggtactgatgcctgaagaatgtttaaagaaatagctattgcttctctagtaacttctgtgcatgtgtatccactattatataaaagtcaaattcaactaccaagcaggttgacatgttcatgacaacattttcagttgcctatcttcattagctaatgtgttacatgtaatttgacaggcgtgttacatttgattgaaataagcataaagaaaagctgcctcgaaaaaagagaaaagctgtcttaaatcaggggttttatagctccagaaatatacaaagttaggaatttcttttgacttgaacttggtgggatacctgtataactgatacataacacacgggcaaactgtgggagtaacctggttgattaacttttctcctcagtttcaccagggaacaataataggtacctgagtctttgatgaaaaacttaaccttaagaactagcaaaataacattctcaaataattaataaagaatcccagtagcagaaatgttttaactggcatgtttcttctttgtccgctaaaatgtattgacaccacacatggaataatgcattatgacaataattaactttttgaagtttggtgttttgagagtatgaaatgaatgaataagataaaatatccttgcatatgcatgtaagacctataaggaacgcagtattgaaaataaaggaatcaaaatttttacccatggaattttagggttgggtaaatcattcatttatcttaaatctatggtttgctggcagttatcaatctgctcaattttagcattgttgtatacaagaaagtaaaaatttaggtataacataagccagcctcttaagttctctatagtgattatctgtgtactgactgaatcagtgaatgagaacactagacataccagaaactcgtgcttgtcatctccaagccaatggacttaactgtttgtggcatttaagtccataaaacatacttcactgtcaaacacataggcttataggtttcgtcagttttccatgtgtaagataaatgtctgttcttagccatccagatattcagtcaaatttaaatacaaccttggagagagaaagtggaatttatttattttaaatgatgcatttgaaatctatagtattcctaaaagtcttctaaacagtattaaatgttctacccataaaggttcccagaaaatatttgagtaaatctatctgatggtctagacctgaaaataaagaaagtttattttgctgggcgctgtggttcatgcctgtaatcgcagcactctgggaggccaaggcggatggatcacttgaggtcaggagttcgagactattctgcgcaacatagtgaaaccctgtatctacaagaaataaaaaaattagcccgccatggtggcctgtgccccatgtttctcagctactcggtaggctgaggtgggaggatcacctgagcctaggg

SEQ ID NO: 65513 - DNA, 699 bp, Homo sapiens
tgagctatcaccctatagaagaactaatgttagtataagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 65514 - DNA, 1893 bp, Homo sapiens
atctgaatctgagaactgactgggatttggtatgtgaacaactggagagaaccatacactttataattaatattatatccagtgatttcaaataatatgatagattttgctgatacagtactgctgtctgtgttcctactcatacacttacctggttacagatgttaggtcaagatgaggtctgcatctaatcctgtataagagcagagatttttcatagggtgctgtgagggctttgctaactctattttgtccgattggccagaaaaaggatgctctaatggaaatagcaaacctgtatcattaaactctttagaaacaaagaaactggtttaataggcagaaatgtgtttatgtttgtgtcgtgtaattctgcaacacaatgttagagatgactgacctttctcctagtaaaactagaatgtctaattgtccttaaatggtactgatgcctgaagaatgtttaaagaaatagctattgcttctctagtaacttctgtgcatgtgtatccactattatataaaagtcaaattcaactaccaagcaggttgacatgttcatgacaacattttcagttgcctatcttcattagctaatgtgttacatgtaatttgacaggcgtgttacatttgattgaaataagcataaagaaaagctgcctcgaaaaaagagaaaagctgtcttaaatcaggggttttatagctccagaaatatacaaagttaggaatttcttttgacttgaacttggtgggatacctgtataactgatacataacacacgggcaaactgtgggagtaacctggttgattaacttttctcctcagtttcaccagggaacaataataggtacctgagtctttgatgaaaaacttaaccttaagaactagcaaaataacattctcaaataattaataaagaatcccagtagcagaaatgttttaactggcatgtttcttctttgtccgctaaaatgtattgacaccacacatggaataatgcattatgacaataattaactttttgaagtttggtgttttgagagtatgaaatgaatgaataagataaaatatccttgcatatgcatgtaagacctataaggaacgcagtattgaaaataaaggaatcaaaatttttacccatggaattttagggttgggtaaatcattcatttatcttaaatctatggtttgctggcagttatcaatctgctcaattttagcattgttgtatacaagaaagtaaaaatttaggtataacataagccagcctcttaagttctctatagtgattatctgtgtactgactgaatcagtgaatgagaacactagacataccagaaactcgtgcttgtcatctccaagccaatggacttaactgtttgtggcatttaagtccataaaacatacttcactgtcaaacacataggcttataggtttcgtcagttttccatgtgtaagataaatgtctgttcttagccatccagatattcagtcaaatttaaatacaaccttggagagagaaagtggaatttatttattttaaatgatgcatttgaaatctatagtattcctaaaagtcttctaaacagtattaaatgttctacccataaaggttcccagaaaatatttgagtaaatctatctgatggtctagacctgaaaataaagaaagtttattttgctgggcgctgtggttcatgcctgtaatcgcagcactctgggaggccaaggcggatggatcacttgaggtcaggagttcgagactattctgcgcaacatagtgaaaccctgtatctacaagaaataaaaaaattagcccgccatggtggcctgtgccccatgtttctcagctactcggtaggctgaggtgggaggatcacctgagcctaggg

SEQ ID NO: 65515 - DNA, 2279 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagtgaggaataggttttaatgggtcttgtgtgttttttattattcaggtttttaatcacagttctgttccaaggttatcttactataataagcagttatcttttgatcacccaattcctgaattcagtaagcaagttacaattcaaaaaggaagaagagtaaaaaccttttattgacagtgactttgccactgaattcaagggaatggaactagctgggaacccagttaaaaagaaaatatttgctcctggactacttttactgagatactgttagtaatgacttgcattcacactttcttgaattgtgaaaggataattgtaaaaagttagatggagaatcacagttttgttgttgttgttttttctttgagacagagtttcactcttgttgctcaggctggagtgcagtggcacgatcgtgctcactgcaacctccacttcctgggttcaagcgattctcctgcctca

SEQ ID NO: 65516 - DNA, 437 bp, Homo sapiens
  misc_feature (6)..(6): n is a, c, g, or t
gtattntttgggaatctagaaaataaaaacactagttgtaacattgattttaccctggatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 65517 - DNA, 372 bp, Homo sapiens
ggaaacgatctttagaaacagattgtttaagtgttaagataattaacagctatgaaattactgttttgtcatgaaggatgtgaacagatgcattgaggccttggatgaacttgcttcacttcaggtcacaatgcaacaagctcagaaacacacagagatgattactacactgaaaaaagtaagtgatttcaagtcatgtggattctttgaattttgtcattacttcatttaaaaattgtttaaaaaatcaattaggaaaacaattatgatgaatgtatattgttttctcagatacggcgattcaaagttagtcaggtaatcatggaaaagtctacaatgttgtataacaagtttaagaacatgttcttggtt

SEQ ID NO: 65518 - DNA, 241 bp, Homo sapiens
ggaaatgcatttttctcactttataatgttgagacacaatgtttttaatttcagaactctacagagcaaaacagatttccccaatgctttcagttaaacgtgcttgtaacttttagtttaacaaggtttctttcattcctggaataatttattcagtattcagttttcttttttcttttttaggatgtgactaaagcagttgacataactactccaaaagctgccagaagggggagaaaga

SEQ ID NO: 65519 - DNA, 3325 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 65520 - DNA, 3423 bp, Homo sapiens
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggttacagatgttaggtcaagatgaggtctgcatctaatcctgtataagagcagagatttttcatagggtgctgtgagggctttgctaactctattttgtccgattggccagaaaaaggatgctctaatggaaatagcaaacctgtatcattaaactctttagaaacaaagaaactggtttaataggcagaaatgtgtttatgtttgtgtcgtgtaattctgcaacacaatgttagagatgactgacctttctcctagtaaaactagaatgtctaattgtccttaaatggtactgatgcctgaagaatgtttaaagaaatagctattgcttctctagtaacttctgtgcatgtgtatccactattatataaaagtcaaattcaactaccaagcaggttgacatgttcatgacaacattttcagttgcctatcttcattagctaatgtgttacatgtaatttgacaggcgtgttacatttgattgaaataagcataaagaaaagctgcctcgaaaaaagagaaaagctgtcttaaatcaggggttttatagctccagaaatatacaaagttaggaatttcttttgacttgaacttggtgggatacctgtataactgatacataacacacgggcaaactgtgggagtaacctggttgattaacttttctcctcagtttcaccagggaacaataataggtacctgagtctttgatgaaaaacttaaccttaagaactagcaaaataacattctcaaataattaataaagaatcccagtagcagaaatgttttaactggcatgtttcttctttgtccgctaaaatgtattgacaccacacatggaataatgcattatgacaataattaactttttgaagtttggtgttttgagagtatgaaatgaatgaataagataaaatatccttgcatatgcatgtaagacctataaggaacgcagtattgaaaataaaggaatcaaaatttttacccatggaattttagggttgggtaaatcattcatttatcttaaatctatggtttgctggcagttatcaatctgctcaattttagcattgttgtatacaagaaagtaaaaatttaggtataacataagccagcctcttaagttctctatagtgattatctgtgtactgactgaatcagtgaatgagaacactagacataccagaaactcgtgcttgtcatctccaagccaatggacttaactgtttgtggcatttaagtccataaaacatacttcactgtcaaacacataggcttataggtttcgtcagttttccatgtgtaagataaatgtctgttcttagccatccagatattcagtcaaatttaaatacaaccttggagagagaaagtggaatttatttattttaaatgatgcatttgaaatctatagtattcctaaaagtcttctaaacagtattaaatgttctacccataaaggttcccagaaaatatttgagtaaatctatctgatggtagaaccgactagtcggttctaccatagcgacagcaggcaggg

SEQ ID NO: 65521 - DNA, 1867 bp, Homo sapiens
  misc_feature (1835)..(1835): n is a, c, g, or t
  misc_feature (1842)..(1842): n is a, c, g, or t
ggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagcgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaacaccagtgaagagaagagctgaatncctgagntcacacagtacagtgcatctgatat

SEQ ID NO: 65522 - DNA, 1016 bp, Homo sapiens
  misc_feature (426)..(426): n is a, c, g, or t
  misc_feature (1013)..(1013): n is a, c, g, or t
tcttataaatacagtgacgctccagcctctggaagcctctgtcagctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtataaaaaaaaaaaaaaaaaaanaaaaaaaaaaaaaaaaaaaaaaaaaaaaaaaaaaaaaaagaaaaaagaagagagggggcggcgcgcccacaaaagaatcctccccgcagggggcgcgccaaagaataagcgaggcacccacagtttttgtgagcaacacaagggcggcgccactaaaagaggagggcgtattaaataaacaggaagcgcagcgggggcgggtataaaccaagtgttagtggtggtgggggagaaatgtgcgtgtttgtgtgtgtggagacatacttgtgtgggagaagagaaagacacaataatcattacggagggggggggcaacaaaaatgtggtgggggaaaaataatactcctgacgaggagaaattataataaggccgctctcgagaggagaatatttacacaacactttacacacggtggattaagagggtgttgtgtaacaccacagccggcggagtaatatgctgtgtgacgtgacggcgagtaaaaaaaatgttgtgaggcccaacgaaggaaatgtaatagatttttggacgacacaaaatatatattcaaccccgagcgaagtgtgtgtgaaagcatataaacggngtg

SEQ ID NO: 65523 - DNA, 404 bp, Homo sapiens
ttcagacacctcatttcatgagtagccccaaagatcaatcatgggccaatttcttggaagagaagactctccggtgttttgcagttatttgttctgctttcgcgagatgttctcaaatcgttgcagctacaagccatgagtctgaagtgtttgtgttccctccttacaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtata

SEQ ID NO: 65524 - DNA, 445 bp, Homo sapiens
gctagacacagggtgctgattggtgtgtttacaaaccttgagctagatacagagtgacaatttgtgtatttacaatcccttagctagacataaaggttctcaaagtccccaccagactcaggagcccagctggcttcagcaagtgggtcccacatgggggccgcaggtgagctgcctgccagtcccgtgccctgtgctggcactcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtata

SEQ ID NO: 65525 - DNA, 407 bp, Homo sapiens
tcttataaatacagtgacgctccagcctctggaagcctctgtcagctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtata

SEQ ID NO: 65526 - DNA, 383 bp, Homo sapiens
gtaggaataggctaggcatggtgtttcagacctgtaatttcagcatttcgggagactgagttaggaggattgcttgtgtaacatttagtacttaaccttacgtaattatgaatgcaagttttttgtcctgggtgcaagattatatttatttgagcgtatcaagtgaacaagtttacatttaaaggcgagagttataggtcagccctggcaacatagtgagaccctatatctacaaaaattttaaaaaattagctgggcgtggtggctcatgactatagtcccaaatactcaggaggctgaggcaggaggatcacctgagcccagaagttcgaaggttgctatgaatgtgccggtgcactctagcctgggcagtagagggagat

SEQ ID NO: 65527 - DNA, 408 bp, Homo sapiens
caagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtgggggcctgaacacagaagcttctgtccccacggggttgggggcaccaccctcatggcacagagatgtggtcatcaaccagggagctcttggaacctcaccacggagaaggttttatggagg

SEQ ID NO: 65528 - DNA, 370 bp, Homo sapiens
ttgagcccccatagggactagcactgggtctttaaattcgagctactaagtactttttaaatctatgccctcctgtccaaaaacaatactacaatttaaacctccattatcttctgcctgaactatcctaatggaagcagaattgatttcattctttctaatccagaatgacctttcaaaatacaaacctgaacatgtcatttctcaagtacaggacagactctaatctcttggcttagaaattgttttgatccagctttcactacctacacagctaccacctccagtctctgatccttcctaatgcatcccatattcccaccttacccaattgtccatcacttcccaaccataccatgctcctgtatct

SEQ ID NO: 65529 - DNA, 500 bp, Homo sapiens
ccagttggagagtagcagcactggggaaaaaaaatacctaacgtgacaaagtgctgtaaattagcctcagagaaatacaatggacagatgcaaagaaatctatctcatgtgatttgagttatgccactgagcagaagacatgaaaatccttatttcttggcaatgtttacctgtaagtttttacctactcctggcgtatttacagtttagggtgaaaagaatttgaaaagcaaaaattgcaaggaaacattacaatccaagtaattgcagcactagactaatagatcagtgtctgaggaggcgatcagataggcagaagaacagctctctaaatcctcccttcggacacagtggagttcctcgctgtcttttgaaggcttcataccaatccctccttcctcggcagcaggggctacttctctccctctctcccaaaggcgaagtgagtccactcagagcacctctttccactctcagtcatggccaatttagggccctta

SEQ ID NO: 65530 - DNA, 245 bp, Homo sapiens
caagaaatgaagaaggtgagctgggggatgcagctgggactcagaagactgcacgtgatagactcatgagctgaagatctcgtgcttagtctggagaagctcatcaagtctagctcactttggaataagttggtgctggagaatgaattcatgctaaccaaattcaccaagagcctgatttacaaatgagagagccaaggccttaagtttagagcaaaagacaaacttccaatgactttagtttt

SEQ ID NO: 65531 - DNA, 488 bp, Homo sapiens
gggcaggggctgttacaagaggcttatagtctagtggcagagacaaaaaccacactcaaatcattagtgtacggtatgcactgctcagggactcaaatatgtgacaggaggctccaaacaagagcggagacaaggcgtaaatagccccctgtggactggatgttctgactcctggatggcctccagaaggatgccttttacggtctgtgaaagagctcagggaccaagatgctcaaagcccttcatgcccaagagcccctcctcaggctgggacacgggaagcagagctcggaggtggaactcgtgactgtgtatgggcacatgtgagtgcgtgtgtgtggacagccaggcttagtgtagacaacgtgtgaggctcagaccccaagtgctgactacacctatgcacatccccacctgcgtgtgaaagaagatgctagaaaagaacaaaaataacttaaaaaataaatccaataagatggctggaacat

SEQ ID NO: 65532 - DNA, 344 bp, Homo sapiens
atagtctatatgttgtgtatagtaagggttacattacattatttttaagaatccaaagaactgtatacctaaaaagagtgaattttgccatatgtacattatacctcaaaaagcatgaatgtttaaaaagtgtgatcaagagagtcgctgaagatacatgagaacataacagatagtgataaaaattctactggatttgtcaaaagttttaaaaattattttctaataatttcagaagtcaaatatgcatactgaataatatataatctagtaattttctagcactatcaagtaagactacctaaaattttgagtttgggttaagcttagcaatatttgcctta

SEQ ID NO: 65533 - DNA, 330 bp, Homo sapiens
cccaggaggcagaggttgcagtgagccgagaccacaccattgcgctccagcctgggcaacaaaagtgaaactccgtctcaaaaaataaaataaaattacagtgctgtatactcttttctctttagagaagtagaggtgtattattggccttctgttgcactggtaatagtggattacttacttatttgattgcttgtttctacctgcatacatggaattcaattttaagtgtagggcgaggtttgttgcctaaacaataagtaagtagcaatagaaatttatgagatgtttgtggggaataaacaattgcatgtattcctatttagtaaa

SEQ ID NO: 65534 - DNA, 889 bp, Homo sapiens
aggagacccttttctccttgaggatagggataggtaaggtaaacttgtaaaaaggatgtcacagaagtcactttttaattaagtcatgattgagatactgaactcttccatctcattcttctttcccattttcctattatgtttgataattatatgtatttttaaaaactgtgagaggaaaaattagtcataacccttttgggttatccacttaaatttaggtattttcatattactcaggtaaagatggaaatgacagagcacagacatttattttttaaattgatagggtagaaaatgaaatgtacttctgtttattcttaatactatatatatatatacacacatagttttagcaaattggaaataatatattcatttgtatggcaagataaatgcagtcatcttaatactagtctatacatttttgccaaatggcgcaaatatacctccatttatattttgtatcttaaaatgtagtttaaaaataggaccatgtatgagacacttttttacaaaaagtgccgtatatacatatgtaacaggtgagtgtgtgtttaacataatttataattatttctgtcagtacagcgtatatggaaaattcaagttgtttttaacatattcaagtatgttcagtataaaataagttaatcccatttcataatgtaaatcatatttttgttatttgccatattttatttgaagtgataaaattttataactcaaatttgaatgtcatagtacattgtgtgctaaccatggcaagcaaacatttacatttgttttttacaataaatttcttttaaaatatactttctatttttctgtactgacatatgcaataaattggtacattaaaaatttgattaatgtcttcaaatagttt

SEQ ID NO: 65535 - DNA, 855 bp, Homo sapiens
tgtatttgagactgtttccttagatgggtaagaggtggaaaacaaacttagtatcaggggtccatgaagcccatggcatcatttttgaaaatatttctagttttgtagccaaagcaattggttttagtaaaatgagacttcttcaggagtcactcctttactgtggacccattgcttagtgggaatggaagtatatgtatctatcttgtgtattaacttctgacttatttatacaagagcagctataggagtttacaaaagaactttaagttattaagttactataaatttggggatcctagagtgatcttaaatatggcaagatacagctcatttagaataaaatctcacatccattattttaaagggaatgattggggggaaaaactggtgaaaaagaaatataaaaaggaccctaaaaagaattctgcaaaataagagaagaaataatttgtgacaggtaatagaatactagtaggatagaaacaactagaaaggaaagtgtgacacagtttttaaatttagatgtagaaaataatgaattaatgagattggtgaaaggaaatcatgcaaaacatttgaatgcaaagcatttctaacaaaaagtgactggagcacttgccattgcaacaaccctgtttttgcaattaggtttttgactgttaaaatggatattttcataaacacttgatatttacatagattacagctttggtaatatgtcactggagtaattacgctgtaatacctgttgagaattcataccatctgatgcttatatattaatttcttatgtttgtaagtttggctttgtgggaataggtgtggagaaattaaagagtgaaggccatattt

SEQ ID NO: 65536 - DNA, 668 bp, Homo sapiens
aaggaaatcatgcaaaacatttgaatgcaaagcatttctaacaaaaagtgactggagcacttgccattgcaacaaccctgtttttgcaattaggtttttgactgttaaaatggatattttcataaaaatggtgttctgaattttgctacagggctgcttaaatttatgattacctgtagacacttgatatttacatagattacagctttggtaatatgtcactggagtaattacgctgtaatacctgttgagaattcataccatctgatgcttatatattaatttcttatgtttgtaagtttggctttgtgggaataggtgtggagaaattaaagagtgaaggccatatttcattttttataaattatctttcaagctcagatagcttaagagcagtttatattaaggagacccttttctccttgaggatagggataggtaaggtaaacttgtaaaaaggatgtcacagaagtcactttttaattaagtcatgattgagatactgaactcttccatctcattcttctttcccattttcctattatgtttgataattatatgtatttttaaaaactgtgagaggaaaaattagtcataacccttttgggttatccacttaaatttaggtattttcatattactcaggtaaagatggaaatgacagagca

SEQ ID NO: 65537 - DNA, 887 bp, Homo sapiens
  misc_feature (880)..(883): n is a, c, g, or t
  misc_feature (885)..(887): n is a, c, g, or t
ggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagagcttttgattgaagtgtcgcttcccattattatttacaactgtaactgatacattagaatttgcttcaaacatgtctgctgtaaaacctttatcaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagctctgctagatctatctacagatataacgctgtaaaatctggtccttttggatgatctataatgagttgattattaataaaagaagtcaacaataccttaannnnannn

SEQ ID NO: 65538 - DNA, 323 bp, Homo sapiens
aaggacatccaaaagggagagcttgcactgaagcagggaggcataagaaatcctgatgagtcaaggaaatggggttttaggatgaatggacttctgagtgtgagatagagaaaggctagagactggtgtgttggatccagattgcagtggccttccgtgtagcctaagaagttttgaacactgcattcaattatttttttatcatttatactctgccttgtttcagaaaggttttaagggccagaagtttgaactaatgtttttttcaataatagggagctaatggaggtttcttaattggaaaacacttggtcagctaattg

SEQ ID NO: 65539 - DNA, 348 bp, Homo sapiens
gccaaagaaagagagacaggagtgtccccctaccctacattgaaaaaaacaaactcaaacaaaaacagaaggaaaaattagattatttgccagatgggttttatccttaaatagaaaaatattgtccagaaatacttaggtgtatttaatatgctcttgccttgttactgctgtagggagaaaaaaggtcatggctcctgctgtgcaggtcagaccatggacctcttattttgctgctcagccatgaacaagtagtatagagtaagcatcctgggtgagacaactgtctaccaagaaaaccctgccagagtgttctggattagaaacaccacaacctctcataatact

SEQ ID NO: 65540 - DNA, 409 bp, Homo sapiens
tccttacccattgccctggccacttcccttcaatgcaacagactcagatgtccagagctgtggagagttctttctaaaggtagaataactgctttgtccaactccccaatccctctcctctgagcagatgactttcagatacctgagagataagttgtagtttggcttcagaatgttgataaaggagaggagcgttctcttcaagagcaaacaccctgaggtttgggcaaaacctcggggtattgggcaatgagagtgatcaaatgatacaatttcattatctttgcccgtctgcatggatctattggctttgggaggccaagaagaagagtttcaaaagaatagttttaaaaaaatcatcaaacagccaattcacagctgtgtcctggatggtagaccaggtggtaaa

SEQ ID NO: 65541 - DNA, 425 bp, Homo sapiens
aaaagaaccttcgccgagaaggctgctaatgaattcagactgcatagttctcaaaatctgatgttttgcaatgatgacattagcgtggcggccgagggtccgagcccagaaagtctgcgcagtgctcggcgctttgagcgccgggacaatgggcgcagtgttcggcctcggcctctccaggccatttgcataccccgttctgcctgagtgaccggcggactgcggcagggagcagcattgtccacgggtcacttcaagatgagcgagatgacaagagccagaaacaccattttgaaaagttgcaactgaggccccttggccggcaaatctgagctgcagaagcgcctgaattccggacgttaaacctccaatcaccagccagggcagctccggctgggacagcgcgggcgcgcggcccctccacc

SEQ ID NO: 65542 - DNA, 3070 bp, Homo sapiens
tggtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacatttttttaagcatgcta

SEQ ID NO: 65543 - DNA, 3166 bp, Homo sapiens
tggtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacatttttttaagcatgcta

SEQ ID NO: 65544 - DNA, 3039 bp, Homo sapiens
tggtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacatttttttaagcatgcta

SEQ ID NO: 65545 - DNA, 1628 bp, Homo sapiens
tggtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatacagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacatttttttaagcatgcta

SEQ ID NO: 65546 - DNA, 2943 bp, Homo sapiens
tggtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacatttttttaagcatgcta

SEQ ID NO: 65547 - DNA, 2103 bp, Homo sapiens
tggtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacatttttttaagcatgcta

SEQ ID NO: 65548 - DNA, 1946 bp, Homo sapiens
ggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggtcggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcgggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctttgcagagctgggctctaccccaaaaggcttcaggccagctgccacagctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcatat

SEQ ID NO: 65549 - DNA, 4618 bp, Homo sapiens
  misc_feature (1909)..(1910): n is a, c, g, or t
  misc_feature (1925)..(1925): n is a, c, g, or t
  misc_feature (1944)..(1944): n is a, c, g, or t
  misc_feature (1958)..(1958): n is a, c, g, or t
  misc_feature (1966)..(1966): n is a, c, g, or t
  misc_feature (2003)..(2003): n is a, c, g, or t
  misc_feature (2009)..(2009): n is a, c, g, or t
ggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggtggactgcctggaaagtactctagaaaagtcactccaagcaaagtttccttcaaatctcaaggtctccattctcttagacttcacgcggggctcacgaggtcggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggcagtctgttcactttccatctggtacccactccactaagtcccaaggcgcctgtgctggggtcggcagtggcagcctgtagtccccttctgctctcccttcccnnggggtcctgaagaanccctggggcaagggctcanggatgagggggcanaaaggcanattgagcccctccaagctgagcacactggtgcagganatgtanacgtgggaggaggggagcacgtttgctcgtgagagtggctctggcttgctgccctggccggctgtagtgcacagggtggggcgtcggtagagccagaccgtgggctgctgcctggacgcctcgctgacatccctgtgctgcggttacagagctgcgcccttctagactctggaagttgagtaacaggacctgctctgcccacccaggaggggcctgccgcttcaccagaggcaccagtggggtcccacagtcacctgaggtacccctggactgtcttgacgcctagaggtccgggcagggggtggctgccattaaaggtggggtctttgctgagtgaccttttgtgtcctggatccctcagggcctggactgcactccgggtggggtcaggctcccgaggcccctgctctctggttctggatgttgtgggtagttctgttgctttggatggctgggcctttggatggtggcttgtggggaagggacggtgaggagtcaaagatgagccaggacccatgtggccggcacatgcgctagtgccggcatctcatgtgtgcagcgtgggctcccttagtgcctggcaccttagtgctctgctaagtctcattgtttaaaaatgtgtagtttatctgcagcttttcctagttattttaattacttttcattttatttgaatagtgtgtgcaaatgtagagagtaaaacaatactgcggccatttcctgccctcccttcccccaggcagccactcttggcttgtttcttctgatgtgcacacgtgtccgtatttctaaataacgtgcatatcctgctgtcttcccccaaaatgtgtacttaaccaaaacagcaccagtgtcactcctgaaacaaaaattaccaagaatgtcttagtatcatcaaatacctaaatggtgttcacaattccacttgccttaaaattaattttttcgattatttgacttgaagtccaattaaggactacaccttgtgattgttttttccctagcaatttattttttgaagaatgaactttatttttattggatctacttaaaacatttttgtgtcacctagtagcaggggattttgaatacatgtcatgtgtgtttataaagccagctctccatatcccccagtgtctccaggagctgcttttgtgacctcactgcctgatctctttatcatcttcaggtgcttgacccttgcacagagagaagcttcctgggctacagggcatggcagcctgtcctttcggggagtgagattagatttagtccctgcactttgcctctctagaagcagcttctcgcctttccctcccgagggctggcaggagtcactgtcagtcacccttcatggggtctgaaaggttgcatgggctcacctggtcttagacaaggacagttgcagcttccgcaccaggcagacctgcagtttgagtggctggggataggtggagcggcggcctggccacagtgccctggacagcagcacatcacatcagttaacactgtttgccttccaactagttattacggtgtcctgtgggacaattagactggaggagccaaaggaatgtgcaggggcactgggtttctgtttggagagaggctctcggtaaacagagttcgcattcctccagattctgtgggaccagagtaaatatcattatgccacagccaggcttaagcaatctatctgcagtgccgttcccgcagcgcacactgctccctctgtctctgccgatgaccttcgaggctgtcctaggcaggttctccctgaggagctccccacaccaagcctccctaactctgcaaagcagccggagcaacagagagcagcgggcggcgggcggcggccgcagtcctcccggctttctaggtgcgcggggctgtcgtgttccagtccgtgttccccgtcgctggagtgcagcttaagtgcgaatcatttcttggaaagtttagagataattttgtcaactacccacaatatgtatgtgtggactagattactttcttatttcaggatctaaaggcaaaatggaaaaacgtcacattttgtggttattaccagggactgaagtgagttgcccggtggcccctggtggctttagctcccctggtcacctgaagggctgcagtgacccctcctggccagcagaggtattggcccagccaggctgggggaggctgaaactgcttcccttctctgcagccacaaagggctggattccttgggcgccaggaggggaggatttttcttttccctccgatagccctactgggcgctaagattgttgtgaatcattaccctcagaatttggactttctagatgcttcttaacccatgatttaggtgagtaaacttggaaaaatgtttttgcaaaacttgatgatcaagctgaacgtagaacgatattcctaatgggtgtgtttgccttttttcccccttttgagacagggtctcactctgtcacccaggctggagtgagtggcatgatcatgcctcgctgcgtacttgagcccaggaggtggaggttgcaacgtgagccgagattgcgtcattgcactccagcctgggcgacaagagtgaaactctcactctccctcga

SEQ ID NO: 65550 - DNA, 3652 bp, Homo sapiens
  misc_feature (943)..(944): n is a, c, g, or t
  misc_feature (959)..(959): n is a, c, g, or t
  misc_feature (978)..(978): n is a, c, g, or t
  misc_feature (992)..(992): n is a, c, g, or t
  misc_feature (1000)..(1000): n is a, c, g, or t
  misc_feature (1037)..(1037): n is a, c, g, or t
  misc_feature (1043)..(1043): n is a, c, g, or t
aagcagtcgtatcaacgcagagtgcccattacggccgggagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggcagtctgttcactttccatctggtacccactccactaagtcccaaggcgcctgtgctggggtcggcagtggcagcctgtagtccccttctgctctcccttcccnnggggtcctgaagaanccctggggcaagggctcanggatgagggggcanaaaggcanattgagcccctccaagctgagcacactggtgcagganatgtanacgtgggaggaggggagcacgtttgctcgtgagagtggctctggcttgctgccctggccggctgtagtgcacagggtggggcgtcggtagagccagaccgtgggctgctgcctggacgcctcgctgacatccctgtgctgcggttacagagctgcgcccttctagactctggaagttgagtaacaggacctgctctgcccacccaggaggggcctgccgcttcaccagaggcaccagtggggtcccacagtcacctgaggtacccctggactgtcttgacgcctagaggtccgggcagggggtggctgccattaaaggtggggtctttgctgagtgaccttttgtgtcctggatccctcagggcctggactgcactccgggtggggtcaggctcccgaggcccctgctctctggttctggatgttgtgggtagttctgttgctttggatggctgggcctttggatggtggcttgtggggaagggacggtgaggagtcaaagatgagccaggacccatgtggccggcacatgcgctagtgccggcatctcatgtgtgcagcgtgggctcccttagtgcctggcaccttagtgctctgctaagtctcattgtttaaaaatgtgtagtttatctgcagcttttcctagttattttaattacttttcattttatttgaatagtgtgtgcaaatgtagagagtaaaacaatactgcggccatttcctgccctcccttcccccaggcagccactcttggcttgtttcttctgatgtgcacacgtgtccgtatttctaaataacgtgcatatcctgctgtcttcccccaaaatgtgtacttaaccaaaacagcaccagtgtcactcctgaaacaaaaattaccaagaatgtcttagtatcatcaaatacctaaatggtgttcacaattccacttgccttaaaattaattttttcgattatttgacttgaagtccaattaaggactacaccttgtgattgttttttccctagcaatttattttttgaagaatgaactttatttttattggatctacttaaaacatttttgtgtcacctagtagcaggggattttgaatacatgtcatgtgtgtttataaagccagctctccatatcccccagtgtctccaggagctgcttttgtgacctcactgcctgatctctttatcatcttcaggtgcttgacccttgcacagagagaagcttcctgggctacagggcatggcagcctgtcctttcggggagtgagattagatttagtccctgcactttgcctctctagaagcagcttctcgcctttccctcccgagggctggcaggagtcactgtcagtcacccttcatggggtctgaaaggttgcatgggctcacctggtcttagacaaggacagttgcagcttccgcaccaggcagacctgcagtttgagtggctggggataggtggagcggcggcctggccacagtgccctggacagcagcacatcacatcagttaacactgtttgccttccaactagttattacggtgtcctgtgggacaattagactggaggagccaaaggaatgtgcaggggcactgggtttctgtttggagagaggctctcggtaaacagagttcgcattcctccagattctgtgggaccagagtaaatatcattatgccacagccaggcttaagcaatctatctgcagtgccgttcccgcagcgcacactgctccctctgtctctgccgatgaccttcgaggctgtcctaggcaggttctccctgaggagctccccacaccaagcctccctaactctgcaaagcagccggagcaacagagagcagcgggcggcgggcggcggccgcagtcctcccggctttctaggtgcgcggggctgtcgtgttccagtccgtgttccccgtcgctggagtgcagcttaagtgcgaatcatttcttggaaagtttagagataattttgtcaactacccacaatatgtatgtgtggactagattactttcttatttcaggatctaaaggcaaaatggaaaaacgtcacattttgtggttattaccagggactgaagtgagttgcccggtggcccctggtggctttagctcccctggtcacctgaagggctgcagtgacccctcctggccagcagaggtattggcccagccaggctgggggaggctgaaactgcttcccttctctgcagccacaaagggctggattccttgggcgccaggaggggaggatttttcttttccctccgatagccctactgggcgctaagattgttgtgaatcattaccctcagaatttggactttctagatgcttcttaacccatgatttaggtgagtaaacttggaaaaatgtttttgcaaaacttgatgatcaagctgaacgtagaacgatattcctaatgggtgtgtttgccttttttcccccttttgagacagggtctcactctgtcacccaggctggagtgagtggcatgatcatgcctcgctgcgtacttgagcccaggaggtggaggttgcaacgtgagccgagattgcgtcattgcactccagcctgggcgacaagagtgaaactctcactctccctcga

SEQ ID NO: 65551 - DNA, 2252 bp, Homo sapiens
ggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggtcggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttccccggaagaaagttacacaggacaatggccttgatgaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctttgcagagctgggctctaccccaaaaggcttcaggccagctgccacagctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcatat

SEQ ID NO: 65552 - DNA, 4696 bp, Homo sapiens
  misc_feature (1987)..(1988): n is a, c, g, or t
  misc_feature (2003)..(2003): n is a, c, g, or t
  misc_feature (2022)..(2022): n is a, c, g, or t
  misc_feature (2036)..(2036): n is a, c, g, or t
  misc_feature (2044)..(2044): n is a, c, g, or t
  misc_feature (2081)..(2081): n is a, c, g, or t
  misc_feature (2087)..(2087): n is a, c, g, or t
ggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggtcggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggcagtctgttcactttccatctggtacccactccactaagtcccaaggcgcctgtgctggggtcggcagtggcagcctgtagtccccttctgctctcccttcccnnggggtcctgaagaanccctggggcaagggctcanggatgagggggcanaaaggcanattgagcccctccaagctgagcacactggtgcagganatgtanacgtgggaggaggggagcacgtttgctcgtgagagtggctctggcttgctgccctggccggctgtagtgcacagggtggggcgtcggtagagccagaccgtgggctgctgcctggacgcctcgctgacatccctgtgctgcggttacagagctgcgcccttctagactctggaagttgagtaacaggacctgctctgcccacccaggaggggcctgccgcttcaccagaggcaccagtggggtcccacagtcacctgaggtacccctggactgtcttgacgcctagaggtccgggcagggggtggctgccattaaaggtggggtctttgctgagtgaccttttgtgtcctggatccctcagggcctggactgcactccgggtggggtcaggctcccgaggcccctgctctctggttctggatgttgtgggtagttctgttgctttggatggctgggcctttggatggtggcttgtggggaagggacggtgaggagtcaaagatgagccaggacccatgtggccggcacatgcgctagtgccggcatctcatgtgtgcagcgtgggctcccttagtgcctggcaccttagtgctctgctaagtctcattgtttaaaaatgtgtagtttatctgcagcttttcctagttattttaattacttttcattttatttgaatagtgtgtgcaaatgtagagagtaaaacaatactgcggccatttcctgccctcccttcccccaggcagccactcttggcttgtttcttctgatgtgcacacgtgtccgtatttctaaataacgtgcatatcctgctgtcttcccccaaaatgtgtacttaaccaaaacagcaccagtgtcactcctgaaacaaaaattaccaagaatgtcttagtatcatcaaatacctaaatggtgttcacaattccacttgccttaaaattaattttttcgattatttgacttgaagtccaattaaggactacaccttgtgattgttttttccctagcaatttattttttgaagaatgaactttatttttattggatctacttaaaacatttttgtgtcacctagtagcaggggattttgaatacatgtcatgtgtgtttataaagccagctctccatatcccccagtgtctccaggagctgcttttgtgacctcactgcctgatctctttatcatcttcaggtgcttgacccttgcacagagagaagcttcctgggctacagggcatggcagcctgtcctttcggggagtgagattagatttagtccctgcactttgcctctctagaagcagcttctcgcctttccctcccgagggctggcaggagtcactgtcagtcacccttcatggggtctgaaaggttgcatgggctcacctggtcttagacaaggacagttgcagcttccgcaccaggcagacctgcagtttgagtggctggggataggtggagcggcggcctggccacagtgccctggacagcagcacatcacatcagttaacactgtttgccttccaactagttattacggtgtcctgtgggacaattagactggaggagccaaaggaatgtgcaggggcactgggtttctgtttggagagaggctctcggtaaacagagttcgcattcctccagattctgtgggaccagagtaaatatcattatgccacagccaggcttaagcaatctatctgcagtgccgttcccgcagcgcacactgctccctctgtctctgccgatgaccttcgaggctgtcctaggcaggttctccctgaggagctccccacaccaagcctccctaactctgcaaagcagccggagcaacagagagcagcgggcggcgggcggcggccgcagtcctcccggctttctaggtgcgcggggctgtcgtgttccagtccgtgttccccgtcgctggagtgcagcttaagtgcgaatcatttcttggaaagtttagagataattttgtcaactacccacaatatgtatgtgtggactagattactttcttatttcaggatctaaaggcaaaatggaaaaacgtcacattttgtggttattaccagggactgaagtgagttgcccggtggcccctggtggctttagctcccctggtcacctgaagggctgcagtgacccctcctggccagcagaggtattggcccagccaggctgggggaggctgaaactgcttcccttctctgcagccacaaagggctggattccttgggcgccaggaggggaggatttttcttttccctccgatagccctactgggcgctaagattgttgtgaatcattaccctcagaatttggactttctagatgcttcttaacccatgatttaggtgagtaaacttggaaaaatgtttttgcaaaacttgatgatcaagctgaacgtagaacgatattcctaatgggtgtgtttgccttttttcccccttttgagacagggtctcactctgtcacccaggctggagtgagtggcatgatcatgcctcgctgcgtacttgagcccaggaggtggaggttgcaacgtgagccgagattgcgtcattgcactccagcctgggcgacaagagtgaaactctcactctccctcga

SEQ ID NO: 65553 - DNA, 4351 bp, Homo sapiens
  misc_feature (1642)..(1643): n is a, c, g, or t
  misc_feature (1658)..(1658): n is a, c, g, or t
  misc_feature (1677)..(1677): n is a, c, g, or t
  misc_feature (1691)..(1691): n is a, c, g, or t
  misc_feature (1699)..(1699): n is a, c, g, or t
  misc_feature (1736)..(1736): n is a, c, g, or t
  misc_feature (1742)..(1742): n is a, c, g, or t
gcggccgcctactactactaaattcgcggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggtcggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggcagtctgttcactttccatctggtacccactccactaagtcccaaggcgcctgtgctggggtcggcagtggcagcctgtagtccccttctgctctcccttcccnnggggtcctgaagaanccctggggcaagggctcanggatgagggggcanaaaggcanattgagcccctccaagctgagcacactggtgcagganatgtanacgtgggaggaggggagcacgtttgctcgtgagagtggctctggcttgctgccctggccggctgtagtgcacagggtggggcgtcggtagagccagaccgtgggctgctgcctggacgcctcgctgacatccctgtgctgcggttacagagctgcgcccttctagactctggaagttgagtaacaggacctgctctgcccacccaggaggggcctgccgcttcaccagaggcaccagtggggtcccacagtcacctgaggtacccctggactgtcttgacgcctagaggtccgggcagggggtggctgccattaaaggtggggtctttgctgagtgaccttttgtgtcctggatccctcagggcctggactgcactccgggtggggtcaggctcccgaggcccctgctctctggttctggatgttgtgggtagttctgttgctttggatggctgggcctttggatggtggcttgtggggaagggacggtgaggagtcaaagatgagccaggacccatgtggccggcacatgcgctagtgccggcatctcatgtgtgcagcgtgggctcccttagtgcctggcaccttagtgctctgctaagtctcattgtttaaaaatgtgtagtttatctgcagcttttcctagttattttaattacttttcattttatttgaatagtgtgtgcaaatgtagagagtaaaacaatactgcggccatttcctgccctcccttcccccaggcagccactcttggcttgtttcttctgatgtgcacacgtgtccgtatttctaaataacgtgcatatcctgctgtcttcccccaaaatgtgtacttaaccaaaacagcaccagtgtcactcctgaaacaaaaattaccaagaatgtcttagtatcatcaaatacctaaatggtgttcacaattccacttgccttaaaattaattttttcgattatttgacttgaagtccaattaaggactacaccttgtgattgttttttccctagcaatttattttttgaagaatgaactttatttttattggatctacttaaaacatttttgtgtcacctagtagcaggggattttgaatacatgtcatgtgtgtttataaagccagctctccatatcccccagtgtctccaggagctgcttttgtgacctcactgcctgatctctttatcatcttcaggtgcttgacccttgcacagagagaagcttcctgggctacagggcatggcagcctgtcctttcggggagtgagattagatttagtccctgcactttgcctctctagaagcagcttctcgcctttccctcccgagggctggcaggagtcactgtcagtcacccttcatggggtctgaaaggttgcatgggctcacctggtcttagacaaggacagttgcagcttccgcaccaggcagacctgcagtttgagtggctggggataggtggagcggcggcctggccacagtgccctggacagcagcacatcacatcagttaacactgtttgccttccaactagttattacggtgtcctgtgggacaattagactggaggagccaaaggaatgtgcaggggcactgggtttctgtttggagagaggctctcggtaaacagagttcgcattcctccagattctgtgggaccagagtaaatatcattatgccacagccaggcttaagcaatctatctgcagtgccgttcccgcagcgcacactgctccctctgtctctgccgatgaccttcgaggctgtcctaggcaggttctccctgaggagctccccacaccaagcctccctaactctgcaaagcagccggagcaacagagagcagcgggcggcgggcggcggccgcagtcctcccggctttctaggtgcgcggggctgtcgtgttccagtccgtgttccccgtcgctggagtgcagcttaagtgcgaatcatttcttggaaagtttagagataattttgtcaactacccacaatatgtatgtgtggactagattactttcttatttcaggatctaaaggcaaaatggaaaaacgtcacattttgtggttattaccagggactgaagtgagttgcccggtggcccctggtggctttagctcccctggtcacctgaagggctgcagtgacccctcctggccagcagaggtattggcccagccaggctgggggaggctgaaactgcttcccttctctgcagccacaaagggctggattccttgggcgccaggaggggaggatttttcttttccctccgatagccctactgggcgctaagattgttgtgaatcattaccctcagaatttggactttctagatgcttcttaacccatgatttaggtgagtaaacttggaaaaatgtttttgcaaaacttgatgatcaagctgaacgtagaacgatattcctaatgggtgtgtttgccttttttcccccttttgagacagggtctcactctgtcacccaggctggagtgagtggcatgatcatgcctcgctgcgtacttgagcccaggaggtggaggttgcaacgtgagccgagattgcgtcattgcactccagcctgggcgacaagagtgaaactctcactctccctcga

SEQ ID NO: 65554 - DNA, 2675 bp, Homo sapiens
  misc_feature (1987)..(1988): n is a, c, g, or t
  misc_feature (2003)..(2003): n is a, c, g, or t
  misc_feature (2022)..(2022): n is a, c, g, or t
  misc_feature (2036)..(2036): n is a, c, g, or t
  misc_feature (2044)..(2044): n is a, c, g, or t
  misc_feature (2081)..(2081): n is a, c, g, or t
  misc_feature (2087)..(2087): n is a, c, g, or t
ggaagcggcgagtctccatggcggtggcggcggcagctgcggcgggacccgtgttctggaggcgactgctgggcctcctgcctggccgcccagggctggccgcgctcctgggacgcctgtccgaccgcctcggcaggaaccgggaccgccagcgcaggaggtcaccatggctgttattggctcccttgctgtccccagctgttccccaggtcacctccccaccttgctgcctgtgtccagaaggcgtgcaccggttccagtggatcagaaacctggttccagaatttggagtctccagttctcacgttagggtgctttcttccccggcagagtttttcgagctcatgaaggggcagataagagtagccaagaggcgggtcgtgatggcatccctctacctggggacaggtcctttggaacaggagctggtggactgcctggaaagtactctagaaaagtcactccaagcaaagtttccttcaaatctcaaggtctccattctcttagacttcacgcggggctcacgaggtcggaagaactcccgcacaatgctgctcccactcctgcggaggttcccagagcaggtccgagtctccctctttcacacgccgcacctccgtgggctgcttcggctcctcatccctgagcgcttcaacgagaccatcggcctccagcacattaaggtgtacctcttcgacaacagcgtcatcttgagcggtgcaaacctgagtgactcctacttcaccaaccgccaggaccgctacgtgttcctgcaggactgtgcggagattgccgacttcttcacggagctggtggacgcggtgggggatgtgtccctgcagctgcagggggacgacacggtgcaggtggtggatgggatggtgcatccttacaaaggggaccgggccgagtactgcaaggcagccaataagagggtcatggatgtgatcaactcagccaggacccgccagcagatgctgcatgcccagaccttccacagcaactctcttttgacccaggaagatgcagcagctgctggggatcgcagaccagcccctgacacctggatttatccgctgattcagatgaagcccttcgagattcaaatcgatgagattgtcactgagaccctgttgactgaggcggagcgcggggcaaaggtctacctcaccactggctatttcaacctgacccaggcctacatggacctggtcttgggcactcgggctgagtaccagatcctgctggcctcaccagaggtgaatggcttctttggggccaagggggtggccggcgccatcccagcggcctatgtgcacatcgagcgacagttcttcagtgaggtgtgcagcctgggacagcaggagcgggtccagcttcaggagtactggcggaggggctggacgttccacgccaaaggcctctggctgtacctggcagggagcagcctgccctgtctcacgctgattggctctcctaattttgggtacaggtcagttcaccgggacctggaggcccagattgcgatcgtgacggagaaccaggccctgcagcagcagcttcaccaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggcagtctgttcactttccatctggtacccactccactaagtcccaaggcgcctgtgctggggtcggcagtggcagcctgtagtccccttctgctctcccttcccnnggggtcctgaagaanccctggggcaagggctcanggatgagggggcanaaaggcanattgagcccctccaagctgagcacactggtgcagganatgtanacgtgggaggaggggagcacgtttgctcgtgagagtggctctggcttgctgccctggccggctgtagtgcacagggtggggcgtcggtagagccagaccgtgggctgctgcctggacgcctcgctgacatccctgtgctgcggttacagagctgcgcccttctagactctggaagttgagtaacaggacctgctctgcccacccaggaggggcctgccgcttcaccagaggcaccagtggggtcccacagtcacctgaggaatggccttgatgaagatgacaggcatggccggggtcagctctttcagccgcgcttcagcgatgactccagtctgggtgtcccagcgagcccctgcagggacagtatggctgagggtcaggtgtgctgccagagtcgcagcagctggggagtgggtgagactgggccagccagcatgacctggagtctcagtgcagccacaaaacgcacttctgccctgggctgactgctccgtggcagggaaagcctgggcttttcagcgcttttcatcacgtcggagctgctctctcacaagctctgctgttttcattaaagcagaggccaggtga

SEQ ID NO: 65555 - DNA, 107 bp, Homo sapiens
cttgaactttagaactgttactctcaggtgtcaggaaccttaaagaagtttggacttttctttgcagttaggaaatgtaagtgttcattatagataatttataaaat

SEQ ID NO: 65556 - DNA, 332 bp, Homo sapiens
tgagatcagagcttataagcatttcatatcattgtgaggctcttactctaggcaaaattgttgaataaaagcagaaaaagctaattgaaaatgaagtacactggaaatactaaaatcaactgaggtgagagagaagggacatgatggcttcatgaactgtcagttaactcagtgtgtctagtaaaatatcctcattttaaagtatgattagatatttaatgttggattcctttaatatgtcttctgaatttggatgagtcaaataagtcaacagtctttgactgcaccattttggaagctgatcttggatgtgtttctgacactgcagcatt

SEQ ID NO: 65557 - DNA, 476 bp, Homo sapiens
tacttacagctatttggtaggttacagattactacattccaagaaaaagtattttgttactccatgagggggggtagtgatctcagggggttgtatctctggtatggtttggtcctcctattttaattatttatagaaacaaaaggcagacgttgcagatgcctgctgcttgactcaggctgtagccacattcctcccaaggctcggaataaagttccaacagctttaagtttgaattatttaacttccaataactataaagtcattttgtttactaatgtgctaaataaagatatgggctctaggccaggtgcagtggcccaggcctgtaatcccagcactttctggaggccaaggcaggtggatcacctgaggtcaggagttcgagaccagcctggccaacatggtgaaaccccgtctctactaaaaatacaaaaattagccgggcatggtggcaggcacctgtcattccagct

SEQ ID NO: 65558 - DNA, 492 bp, Homo sapiens
tgaggactgattagtgtttatcttgaaaacatgtacttaggctgggcgcggtggctcacgcctgtaatcccagcactttgggaggctgaggtaggtggatcacctgaggtcaggagtttgagaccagcctgaccaaaaaggtcaaactccgtctctactaaaaatacaaaaattagcccagcatggtagcagacgcctgtagttccagctattcaggaggatgagacaggagaattgcttgaacccaggaggtggaggctgcagtaagctgagatcttgccactgcactctagcctgggcaacagagtgagactcttgtctccaaaaaaaagaaagaaaaaagacaaaagaaaacatgtacttaatgggttgtatagaacagtgaagtttctctctctgttttcaacctctcaactgtttgcctctatttcccattacattcaggtctaaggctctttattaataaaatggttgttatttccttctctgtta

SEQ ID NO: 65559 - DNA, 389 bp, Homo sapiens
gattctttccttcatcttgactttagacaacctgatggctgtgtgcccaggtggtaatctttttgcattgaatttcccaggtgttctttgtgcttcttatatttggatatctagatctctagcaagactaggaagtttttcttgattattccctcaaataagtccttaatgaccccactatataacatgaaatatctgttattggtactgaggtgctggccacaaacaattctgtgtgtcctgaaaactcttcagaatattcgtcatctttagcacttgttatcttagtgtttgggcttggcttagagtgatacatctcataacagggcaacagaaagaaccaggaaccaagatttatataacataagtcagtaaaactagaggcacca

SEQ ID NO: 65560 - DNA, 292 bp, Homo sapiens
caggtcaccttttaaagatgtacacaattctgtattcactttttgagtgcataagggtaatagaaaatgacatgggaagcgttaattagaaaaaaaggcattttgtttatgtgcatttgaggatacagtgtttgaagtttctaaataattgttttatgacattttcttggtacatagatattgctaacaattagtttgctgaagtatgtagaaacattttaagaaatgattttagaaatataattgttaaagtacctctgatgtatattaaaaatccttttattttggttta

SEQ ID NO: 65561 - DNA, 299 bp, Homo sapiens
tccttcttcctcaaagtcacaagggagagactttttaataaaatttttcctttccaactaaattcaggcttttgggtggaggacactagcaatatcacctgaaaaacatcattttcctgtacagggtgtgaggtgtaatcagcattccacttactctctgctccatctatcaagtgtaggtcatactggcttacactgaggtcaggaggggttaacgataatgtatgcatgtgcctgtatttggcatgtggtgggggttcaattaaatgacagctaaaaatcatactccttttcagaaa

SEQ ID NO: 65562 - DNA, 297 bp, Homo sapiens
attaattatctcatgggcaagaaaggctgtccaagaagtagacagattggtgtcatcttgagaaaaacttgcagggtgaattatgtagctagagagaatgaaaaaggagaatatattctctctgtcgaggaatggtgaagaggggaattctgaagcctttgggaacacccaaatcaactccatgaaggcttgagcatttgggtgctgctttcatggaggtgtgttattcagccagtgtcagcttagtttcatataaacttgtgatccatagaaaataggctatcatttccggataag

SEQ ID NO: 65563 - DNA, 1696 bp, Homo sapiens
cgggcactatgtctggcacacagtagggtgagagtagttataaatgcttgttgagtaggttcattactgggaggccgaagtctcccaggatttaactctgtgtttcaaatccctaaactgatttcataagcttcattacactcaggttaaatccacatgatcctgactaaactgcactacaactgaaaatgtactcatattcttttaccagctgaagtccatttcaagagtcactatagatcgtacaaaaatggtgaataggccacttgatattttggtatgtgatctaaacaatgtacagattgggttttcaataggttctcaaaaggcaggaagtgaaggagcaagctggtattcacctgtctggtttaggttatgtaggtagttaaactggatagcacaagaccaaaaaaaaaaatttaaacccatttagtgacatgagttctccagactaatccggctgcaacattgctggagtagagaaagttactgctcaataccttttggtttcttatctttatatgggctgaagttagcattaatacctctagagagtaaatgcagatatggggccatacttgagaccagagacaatcttgacttagcggtaaacacaccatatacatccattctctgtcttgagcttacagcaacactaactggaaagtatgataaatatttacattaatactaatatttcttttgcttgtcttaaatgactatgctttttttacaaaaatctcttggtatctctcatgcatgtggaaaaatggactttttagtcactagcatgtcagttgttaactgacccctatccagtttccaaatagaatgtacaatctccctagttcttcgatgtgcatgactggcctttgatgttttaataagtccctgaaatgtatctttaaaaggaaaagggaaatatgcctgggaatagatgcgtgcttctgaaattgtgcataaaatagctatgtaagaaatataagcatcgaaagagtgaaacaccaccttatttctcctctaatcattaatttcaaggtgataagcatttatggttttttctagggcttgtattaaaccactgaacaattgtcttaaagtatactcctcacagaactaaagagtaaaaatagaaaatgttaaaatagtaacaaaatatttacaagatagccttaaaacataatctgtaccataaaacctacaagttaccaattactattcaattaaagttcaaccgtattactgaaatatacttctgattttgaaatgttgagcccaaatatgtgattgcatcttcatgctgcatattcagtgttcactaaaactttaattttaaatgttgcacttcagaaatgtaaaaggatgtccagccaatgtaattttccttcatcacttgtgatattgaccagttttaaagtctttggcctatttttaaaaagtgaggatagctgcatcttttctacttcatatacaacttttctacatgtaaccctcaacttacacattgcctagtgaaacagagccaaaaaatgcagtatcacctgtaccttttaattttattaaacttttttcaatcatgaatttttcaccgtcttccctttataaataaattctagtgacaaatcaagatttggttttattttgatgtaattcacctctcacttttgtcttcaattccttttaacctctctgtacg

SEQ ID NO: 65564 - DNA, 1066 bp, Homo sapiens
gcgtcagaggatcccggaggcaaggaaagtaacggagtatgataaatatttacattaatactaatatttcttttgcttgtcttaaatgactatgctttttttacaaaaatctcttggtatctctcatgcatgtggaaaaatggactttttagtcactagcatgtcagttgttaactgacccctatccagtttccaaatagaatgtacaatctccctagttcttcgatgtgcatgactggcctttgatgttttaataagtccctgaaatgtatctttaaaaggaaaagggaaatatgcctgggaatagatgcgtgcttctgaaattgtgcataaaatagctatgtaagaaatataagcatcgaaagagtgaaacaccaccttatttctcctctaatcattaatttcaaggtgataagcatttatggttttttctagggcttgtattaaaccactgaacaattgtcttaaagtatactcctcacagaactaaagagtaaaaatagaaaatgttaaaatagtaacaaaatatttacaagatagccttaaaacataatctgtaccataaaacctacaagttaccaattactattcaattaaagttcaaccgtattactgaaatatacttctgattttgaaatgttgagcccaaatatgtgattgcatcttcatgctgcatattcagtgttcactaaaactttaattttaaatgttgcacttcagaaatgtaaaaggatgtccagccaatgtaattttccttcatcacttgtgatattgaccagttttaaagtctttggcctatttttaaaaagtgaggatagctgcatcttttctacttcatatacaacttttctacatgtaaccctcaacttacacattgcctagtgaaacagagccaaaaaatgcagtatcacctgtaccttttaattttattaaacttttttcaatcatgaatttttcaccgtcttccctttataaataaattctagtgacaaatcaagatttggttttattttgatgtaattcacctctcacttttgtcttcaattccttttaacctctctgtacg

SEQ ID NO: 65565 - DNA, 337 bp, Homo sapiens
atgatttaatgtatacagatggatatgttcagattacttgcaaatactatgtcattttataccagggacttgagcataattagattttggcatctacgctgtttctggaaggaatcctctgtggatcttgagggacaactgtttttctctattctgaaagttataatcacaaattatagaatacgtaactatgttacttagtatgtataatgatgtgctgggcgtggtggctcacgcctgtaatcccagcactttgggaagccaaggcgggcggctcctgaggtcaggagtttgagaccagcctgaccaatatggagaaaccccatctccactaaaa

SEQ ID NO: 65566 - DNA, 802 bp, Homo sapiens
ctttcttcaaagtcatgggggacttcttgaagcaaagggtggggtaaatgatcaggttcttgtattttaaatatcttgctggctccaatgtggaagctggattgaagtagggcaatagcgaacaagaggagcaatatgggactcaggggaagtttaacaattgcctaagtaatgagtgtaatatggtatcctgaatgaaaccatggaccagaaaaaggacattaggtaaaaactaaagaaatctgaaaagtacagactgtggttaacaactgttttagtccattttgtgttgctataacacaataccacagattggggaatttataaagaaaagaaatgtatttggctcatgattctgcaggctggaaagtccaagagcatggcaccagtatctggcaaggacctttgtgctgtgtcatcccatggcaaaaggtggaagagtaagcgagcatgtgagaaaaaggaaatcaggctgaactcatccttttgtcaggagcccactcctgcaatagctaacctacctcccccatgacagcattaatccatttatgaagacaaagtcctcatgatcaaatcacctcttaataccatcacaatggcaatgaaatttcaacattagttttggaggggacatccaaactatagcaataatgatgtatgaatattagttcattaattgtaaatagtgtatcatctgaatgtaagatgttaacaataggggaaactgggtgtgtggtttgttggagcactctgcactacctttgcaatttttcagtaaatctaagactattctaaaacaaaa

SEQ ID NO: 65567 - DNA, 261 bp, Homo sapiens
aaaataaaatgcttggctccaaaaaactcagtctctggtggatatatacagttgacccttgatcaacgcaggtttgaatgtgagtcaaaacctatttatatgtggattttttttccaatgaaatttacactgaaggttcgtcatggtggctcatgcctgtaatcccagcactttgggaggccgaggggggcagatcacttgaggtcaggagtttgagaccagcctggccaacatggtgaaaccccgtctctactaaaaaca

SEQ ID NO: 65568 - DNA, 6004 bp, Homo sapiens
ccctgcgcccccggctcctccagcgtcagcggctcctgcgcgcgggatgcattgggcaatttttgaaatcctgaagtaggaagagaccccggaggatataagtcgggggtgggggtggagcagagaatctgtgaaagatattcaaagagagaaaaggggaatcctgatcgtttctgcccgtgcttgttttcaacttgagcgtgctagcctttaacttgaagaagtctcattggagcatctagcattctccaggagttattcgaaagctgaaactttcagtggattgtgggcctggggagaagaaggattccgagggtggaattgggaagagcgtgcgtgcgtgtgtgtgtgtgtgtgtgcgcgcgcgcgcgtgggtcggggcgggggcgtcggggggccactgggaattcagtgaagagggcaccctataccatggcagtgcccggcgacgctgcacgagtcaggaacaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctatcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcacttactctcactccccgctgcgggggtggtgctcagctgcttggccgccgcgacatggctggtgctgaggctgaggctgggcgtcctcatgatcgccttgactagcgcggtcaggaccgtgtccctcatttccttagagaggttcaaggtcgcctggagaccttacctggcgtacctggccggcgtgctggggatcctcttggccaggtacgtggaacaaatcttgccgcagtccgcggaggcggctccaagggagcatttggggtcccagctgattgctgggaccaaggaagatatcccggtgtttaagaggaggaggcggtccagctccgtcgtgtccgccgagatgtccggctgcagcagcaagtcccatcggaggacctccctgccctgtataccgagggaacagctcatggggcattcagaatgggaccacaaacgagggccaagaggatcacagtcttcaggaaccagtattactgtggacatcgccgtcatgggcgaagccacggcctcattaccgacctcctggcagacccttctcttccaccaaacgtgtgccacatccttgagagccgtgagcaacttgctcagcacacagctcaccttccaggccattcacaagcccagagtgaatcccgttacttcgctcagtgaaaactatacctgttctgactctgaagagagctctgaaaaagacaagcttgctattccaaagcgcctgagaaggagtttgcctcctggcttgttgagacgagtttcttccacttggaccaccaccacctcggccacaggtctacccaccttggagcctgcaccagtacggagagaccgcagcaccagcatcaaactgcaggaagcaccttcatccagtcctgattcttggaataatccagtgatgatgaccctcaccaaaagcagatcctttacttcatcctatgctatttctgcagctaaccatgtaaaggctaaaaagcaaagtcgaccaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcagctgtggcagaccatattcccaagggaatcctgctgatgagcccctggagagaagtggggtagccactcggacaccaagtcgaacagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggacaaaccaattcttgctcccgaacctcttgtcatggataacctggactcaattatggagcagctaaatacttggaattttccaatttttgatttagtggaaaatataggaagaaaatgtggccgtattcttagtcaggtatcttacagactttttgaagacatgggcctctttgaagcttttaaaattccaattagggaatttatgaattattttcatgctttggagattggatatagggatattccttatcataacagaatccatgccactgatgttttacatgctgtttggtatcttactacacagcctattccaggcctctcaactgtgattaatgatcatggttcaaccagtgattcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaaaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtgacaatggatagaatgggctgtgtttccaaacagattgacttgtcaaagactctcttcaagccagcacaagcatttagatcacaacactgtagaaatttgagatgggcaaatggctattgcattttgggattcttcgcattttgtgtgtatatttttacagtgaggtacattgttaaaaactttttgctcaaagaagctttcacattgcaacaccagcttctaaggattttttaaggagggaatatatatgtgtgtgtgtatataagctcccacatagatacatgtaaaacatattcacacccatgcacgcacacacatacacactgaaggccacgattgctggctccacaatttagtaacatttatattaagatatatatatagtggtcactgtgatataataaatcataaaggaaaccaaatcacaaaggagatggtgtggcttagcaaggaaacagtgcaggaaatgtaggttaccaactaagcagcttttgctcttagtactgagggatgaaagttccagagcattatttgaattctgatacatcctgccaacactgtgtgtgtgtgtgtgtgtgtgtgtgtgtgtgtgtgtgtgtgtgaaagagagacagaagggatggtttgagagggtgcttgtgtgcatgtgtgtgcatatgtaaagagatttttgtggtttaagtaactcagaatagctgtagcaaatgactgaatacatgtgaacaaacagaaggaagttcactctggagtgtctttgggaggcagccattccaaatgccctcctccatttagcttcaataaagggccttttgctggtggagggcactcaagggctgggtgagagggccacgtgtttggtattacattactgctatgcaccacttgaaggagctctatcaccagcctcaaacccgaaagactgaggcattttccagtctacttgcctaatgaatgtataggaactgtctatgagtatggatgtcactcaactaagatcaaatcaccatttaaggggatggcattctttatacctaaacacctaagagctgaagtcaggtcttttaatcaggttagaattctaaatgatgccagagaaggcttgggaaattgtacttcagcgtgatagcctgtgtcttcttaatttgctgcaaaatatgtggtagagaaagaaaaggaaacagaaaaatcactctgggttatatagcaagagatgaaggagaatatttcaacacagggtttttgtgttgacataggaaaagcctgattcttggcaactgttgtagtttgtctttcaggggtgaaggtcccactgacaacccctgttgtggtgttccacacgctgtttgttggggtagcttccatcggcagtctggcccattgtcagtcatgcttcttctggccggggagattatagagagattgtttgaagattgggttattattgaaagtctttttttttgtttgttttgttttggtttgtttgtttatctacacttgtttatgctgtgagccaaacctctatttaaaaagttgatactcactttcaatattttatttcatattattatatatgtcatgatagttatcttgatgtaaatatgaagatttttttgtttctgtagatagtaaactctttttttaaaaaaggaaaagggaaacatttttataaagttatattttaatcaccatttttatacattgtagttctctccaagcccagtaagagaatgatgattcatttgcatggaggtcgatggacaaccaatcatctaccttttctaatttaaatgataatctgatatagttttattgccagttaaatgaggatgctgcaaagcatgttttttcactagtaacttttgctaactgaatgaattctgggtccatatctcccagatgaaaaactgttaaccaataccatattttatagttggtgtccatttctttccaacactgtttgttatgattcttccttgagtacttatatacagacctgctcattatctaaacaatcttaccttctaagtaaaccttgattgtgatttccagtttttattttctctgacgtagtagaaaggaatgtttacattaaaaatacttttgtttctcataaatggatattgtactcccccctttcaaagcattat

SEQ ID NO: 65569 - DNA, 5986 bp, Homo sapiens
ccctgcgcccccggctcctccagcgtcagcggctcctgcgcgcgggatgcattgggcaatttttgaaatcctgaagtaggaagagaccccggaggatataagtcgggggtgggggtggagcagagaatctgtgaaagatattcaaagagagaaaaggggaatcctgatcgtttctgcccgtgcttgttttcaacttgagcgtgctagcctttaacttgaagaagtctcattggagcatctagcattctccaggagttattcgaaagctgaaactttcagtggattgtgggcctggggagaagaaggattccgagggtggaattgggaagagcgtgcgtgcgtgtgtgtgtgtgtgtgtgcgcgcgcgcgcgtgggtcggggcgggggcgtcggggggccactgggaattcagtgaagagggcaccctataccatggcagtgcccggcgacgctgcacgagtcaggaacaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctatcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcacttactctcactccccgctgcgggggtggtgctcagctgcttggccgccgcgacatggctggtgctgaggctgaggctgggcgtcctcatgatcgccttgactagcgcggtcaggaccgtgtccctcatttccttagagaggttcaaggtcgcctggagaccttacctggcgtacctggccggcgtgctggggatcctcttggccaggtacgtggaacaaatcttgccgcagtccgcggaggcggctccaagggagcatttggggtcccagctgattgctgggaccaaggaagatatcccggtgtttaagaggaggaggcggtccagctccgtcgtgtccgccgagatgtccggctgcagcagcaagtcccatcggaggacctccctgccctgtataccgagggaacagctcatggggcattcagaatgggaccacaaacgagggccaagaggatcacagtcttcaggaaccagtattactgtggacatcgccgtcatgggcgaagccacggcctcattaccgacctcctggcagacccttctcttccaccaaacgtgtgccacatccttgagagccgtgagcaacttgctcagcacacagctcaccttccaggccattcacaagcccagagtgaatcccgttacttcgctcagtgaaaactatacctgttctgactctgaagagagctctgaaaaagacaagcttgctattccaaagcgcctgagaaggagtttgcctcctggcttgttgagacgagtttcttccacttggaccaccaccacctcggccacaggtctacccaccttggagcctgcaccagtacggagagaccgcagcaccagcatcaaactgcaggaagcaccttcatccagtcctgattcttggaataatccagtgatgatgaccctcaccaaaagcagatcctttacttcatcctatgctatttctgcagctaaccatgtaaaggctaaaaagcaaagtcgaccaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcagctgtggcagaccatattcccaagggaatcctgctgatgagcccctggagagaagtggggtagccactcggacaccaagtcgaacagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggacaaaccaattcttgctcccgaacctcttgtcatggataacctggactcaattatggagcagctaaatacttggaattttccaatttttgatttagtggaaaatataggaagaaaatgtggccgtattcttagtcaggtatcttacagactttttgaagacatgggcctctttgaagcttttaaaattccaattagggaatttatgaattattttcatgctttggagattggatatagggatattccttatcataacagaatccatgccactgatgttttacatgctgtttggtatcttactacacagcctattccaggcctctcaactgtgattaatgatcatggttcaaccagtgattcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaaaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtgacaatggatagaatgggctgtgtttccaaacagattgacttgtcaaagactctcttcaagccagcacaagcatttagatcacaacactgtagaaatttgagatgggcaaatggctattgcattttgggattcttcgcattttgtgtgtatatttttacagtgaggtacattgttaaaaactttttgctcaaagaagctttcacattgcaacaccagcttctaaggattttttaaggagggaatatatatgtgtgtgtgtatataagctcccacatagatacatgtaaaacatattcacacccatgcacgcacacacatacacactgaaggccacgattgctggctccacaatttagtaacatttatattaagatatatatatagtggtcactgtgatataataaatcataaaggaaaccaaatcacaaaggagatggtgtggcttagcaaggaaacagtgcaggaaatgtaggttaccaactaagcagcttttgctcttagtactgagggatgaaagttccagagcattatttgaattctgatacatcctgccaacactgtgtgtgtgtgtgtgtgtgtgtgtgtgtgtgtgtgtgtgtgtgaaagagagacagaagggatggtttgagagggtgcttgtgtgcatgtgtgtgcatatgtaaagagatttttgtggtttaagtaactcagaatagctgtagcaaatgactgaatacatgtgaacaaacagaaggaagttcactctggagtgtctttgggaggcagccattccaaatgccctcctccatttagcttcaataaagggccttttgctggtggagggcactcaagggctgggtgagagggccacgtgtttggtattacattactgctatgcaccacttgaaggagctctatcaccagcctcaaacccgaaagactgaggcattttccagtctacttgcctaatgatgagtatggatgtcactcaactaagatcaaatcaccatttaaggggatggcattctttatacctaaacacctaagagctgaagtcaggtcttttaatcaggttagaattctaaatgatgccagagaaggcttgggaaattgtacttcagcgtgatagcctgtgtcttcttaatttgctgcaaaatatgtggtagagaaagaaaaggaaacagaaaaatcactctgggttatatagcaagagatgaaggagaatatttcaacacagggtttttgtgttgacataggaaaagcctgattcttggcaactgttgtagtttgtctttcaggggtgaaggtcccactgacaacccctgttgtggtgttccacacgctgtttgttggggtagcttccatcggcagtctggcccattgtcagtcatgcttcttctggccggggagattatagagagattgtttgaagattgggttattattgaaagtctttttttttgtttgttttgttttggtttgtttgtttatctacacttgtttatgctgtgagccaaacctctatttaaaaagttgatactcactttcaatattttatttcatattattatatatgtcatgatagttatcttgatgtaaatatgaagatttttttgtttctgtagatagtaaactctttttttaaaaaaggaaaagggaaacatttttataaagttatattttaatcaccatttttatacattgtagttctctccaagcccagtaagagaatgatgattcatttgcatggaggtcgatggacaaccaatcatctaccttttctaatttaaatgataatctgatatagttttattgccagttaaatgaggatgctgcaaagcatgttttttcactagtaacttttgctaactgaatgaattctgggtccatatctcccagatgaaaaactgttaaccaataccatattttatagttggtgtccatttctttccaacactgtttgttatgattcttccttgagtacttatatacagacctgctcattatctaaacaatcttaccttctaagtaaaccttgattgtgatttccagtttttattttctctgacgtagtagaaaggaatgtttacattaaaaatacttttgtttctcataaatggatattgtactcccccctttcaaagcattat

SEQ ID NO: 65570 - DNA, 808 bp, Homo sapiens
ctaggtgaggctgggtgggatcggccgaggaactttgcctgtaggaggactgatctcttaatgaaatacagaaaaaccatctcagaaaaaggaaaatgggcaatcgtcatagccagtcgtacaccctctcagaaggcagtcaacagttgcctaaaggggactcccaaccctcgacagtcgtgcagcctctcagccacccatcacggaatggagagccagaggccccacagcctgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcatgaagggatgccgtggccaagatcagcctggtcggtgccccatctgtttaatccgggaaggccgtgggcagataaactcggtcagagtcggccaaggtccaggtagagc

SEQ ID NO: 65571 - DNA, 363 bp, Homo sapiens
tttctttgcaaaaaaattaaagaatgtgagacatcatggtccatttctattcttcccttttaagttaccacagcaatttgcccttggtgactggaggccttgctttagtcagcacctgtgtgccgtttaccaccagaggcttggccttctccacactttttaaagagacccgttgacagaatcgttacaaccattcagccaggtttgtggacccttggcacattcgtccttggcactgctgacatttgggaccaggctaaagcgagcagtcctcagggttttgatgtggatcgagatgccaaaaagctgaacaaagcctgcaaaggaatggggcctatgaaccgccatcattgaatctcccct

SEQ ID NO: 65572 - DNA, 1500 bp, Homo sapiens
ctaggtgaggctgggtgggatcggccgaggaactttgcctgtaggaggactgatctcttaatgaaatacagaaaaaccatctcagaaaaaggaaaatgggcaatcgtcatgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcaatgaaggagatgacgtggacaaagatctagctggtcaggatgccaaagatctgtatgatgcaggggaaggccgctggggcactgatgagcttgcgttcaatgaagtcctggccaagaggagctacaagcagttacgagccacctttcaagcctatcaaattctcattggcaaagacatagaagaagccattgaagaagaaacatcaggcgacttgcagaaggcctatttaactctcgtgagatgtgcccaggattgtgaggactattttgctgaacgtctgtacaagtcgatgaagggtgcggggaccgatgaggagacgttgattcgcatagtcgtgaccagggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccacctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctctatcagctgc

SEQ ID NO: 65573 - DNA, 624 bp, Homo sapiens
tcagctcggtaccccacctgtgtgtcttcgcatagtcgtgacaggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccacctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctctatcagctgc

SEQ ID NO: 65574 - DNA, 854 bp, Homo sapiens
ccacaaaacgtgaaagccctacattctctttttctttgtcctgcccagtgagatgtgcccaggattgtgaggactattttgctgaacgtctgtacaagtcgatgaagggtgcggggaccgatgaggagacgttgattcgcatagtcgtgaccagggccgaggtaagacacactccgactccaaagaggcggctgcaacttcttttttttccaccactgatgtcatcaacaaatagtttctattaagggcctatttacagaaaaagtaaaacagagacggccccttgccttcccagaatttgcagaagacattgtgctctgcttcaatctgtttctttttataaaaatacaataatgatcgttgcttctttttttgtcctctgtggctctggaaagctagtggaggggcgcagaggcaaccatgtcgagcagttctcaggggctgcagctatgcatggctccatgttaaggaagacaaaacaaacacacttaaaaaaggtcaaccagcagcaggaacaaaaagagaatgatttctgaattcctgagtgaggcctttccttaactgaacacactgcagaagcaagcacatcagcataaggcaatggttctcaatctttttaaaaactattgctgttctaaggaacctttttagacacgtgtttcttcattgccatcccttccccacaagaaatgttaacaccagagataatactacaaatctgtttatataccatgtggatatcagtgctttatacataaaaaaattaagggctttttcaccccctaaaaaccaatttgtgcttgctctcggagaatgtgtatgtataagaaagaaaagggagaggaagagccaac

SEQ ID NO: 65575 - DNA, 1616 bp, Homo sapiens
tgtccggggggaaaactgttgtaaactttgcctgtaggaggactgatctcttaatgaaatacagaaaaaccatctcagaaaaaggaaaatgggcaatcgtcatagccagtcgtacaccctctcagaaggcagtcaacagttgcctaaaggggactcccaaccctcgacagtcgtgcagcctctcagccacccatcacggaatggagagccagaggccccacagcctgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcaatgaaggagatgacgtggacaaagatctagctggtcaggatgccaaagatctgtatgatgcaggggaaggccgctggggcactgatgagcttgcgttcaatgaagtcctggccaagaggagctacaagcagttacgagccacctttcaagcctatcaaattctcattggcaaagacatagaagaagccattgaagaagaaacatcaggcgacttgcagaaggcctatttaactctcgtgagatgtgcccaggattgtgaggactattttgctgaacgtctgtacaagtcgatgaagggtgcggggaccgatgaggagacgttgattcgcatagtcgtgaccagggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccacctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctctatcagctgc

SEQ ID NO: 65576 - DNA, 461 bp, Homo sapiens
cccatctctacaaaaaaaaaatacaaaaagaaaatatgcaatactaagtaaactgtgccaagtatatcacatcttttacattagataaggtgatagcctggagtgataggaaaggaatctccgttaggtgtgctgagagatggggagtttcgccttttccttcagtaccagctacagaattctattaatatgcatagaggaatggtgtggtccagtgaagaaattttatattcttggtcagctcatcagctgccacctttcatgcttaatattgaactgctgtcattttctgaagcttttaaaaatcatttatgcttcctcagctctgaagcacagcaaagttaaatatcaggcataatgtccatagcaaacggcacttggaacaaaatagcaagtatgctttggtgactcagagctgatcggaaatctactgaaattttgtctctcagatttgtcaagtt

SEQ ID NO: 65577 - DNA, 2055 bp, Homo sapiens
  misc_feature (925)..(925): n is a, c, g, or t
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtggggcctttaggtccaatgggatttctgaaaagtgccttaagttttgctgaagatgaagaatggaagagaatacgaacattgctatctccagctttcaccagtgtaaaattcaaggaagtaagaaaataaggtgatttataattagaaacttaaaggatgaatctggagacaggtagtaagtatcatcatagttcctttctaatgggtagtccactgagtttgagctttctaaaaagggtcttttcagctgggcacagtggctcatgcctgtaatcccagcactttgggaggccgaggtgggtggatcacctgaggttaggagattgagaccagcctggccaacatggtgaaaccccaactctactaaaaatacaaaaattagctgggcatggtggcggatgcctataatcctagctgctcagaaggctaaggcagaagaattgtttgaatctagaggcggaggttgcaatgagccaagattgcgccgttgcactccagcctgggcaacaagagcgaaactctgtctcaaaaaaaaggggcagggggcggtcttttctatttatgtcctagaggacatggtgagtcattacaaaatatcatttactgntccatgctgggcaaagccatgtccttctgagactcgagtctgcgtagttaactatgggtggtgttgtgttttagatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaagatgagcttaaa

SEQ ID NO: 65578 - DNA, 1556 bp, Homo sapiens
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaagatgagcttaaa

SEQ ID NO: 65579 - DNA, 1049 bp, Homo sapiens
gaaccctgaagtctataggtagagaaaattgtaattgttgtaggtaaatttcacatttttcactatgatttattttttctttttctatttaattttcctatagcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaagatgagcttaaa

SEQ ID NO: 65580 - DNA, 1719 bp, Homo sapiens
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaagatgagcttaaa

SEQ ID NO: 65581 - DNA, 1840 bp, Homo sapiens
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatacagagtctcgctgtgttgcctaggccggagtgcatggtgcgatctgggctcactgaaacctccacctcctgggttcgagtgattctcctgcctcagcctcctgaggagctgggattacagcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaagatgagcttaaa

SEQ ID NO: 65582 - DNA, 1416 bp, Homo sapiens
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtggggtttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaagatgagcttaaa

SEQ ID NO: 65583 - DNA, 384 bp, Homo sapiens
gacagcctcatgacctaattcctcccaaaggttccacttcctattaccatcgccttgaggatttggttttcaacatgtgaatcttgtcggggacacagatatccagaccataacagtgctgtaggctaagtctcatttgttttaagttgtgtgtgctcagtgcatgtatttatttacatatctagtaaacacagacaccgcagaacctcattacttggcatcatttggagatgaaggttctggagaagtgaatatttttgtgcttcatttatttctgaatcttaataccaccagagtttgatgaaaatcctctaaagtatattacatgcttccctgccttttaacacggaatttaggaaaatacaggttttcttgatggcttaa

SEQ ID NO: 65584 - DNA, 452 bp, Homo sapiens
  misc_feature (448)..(448): n is a, c, g, or t
  misc_feature (450)..(451): n is a, c, g, or t
tagtaatagcaacttcttcatgggttgtttgaagaatttattgacacaactcacataaagcacttaggatggaaactggtgtcttagcatggaaccttagcatggaacctggtatcttagcatggaaccttagcatggaacctggtatcttagcatggaacctggtgtcttagcatggaaccttagcatggaacctggtgccttagcatggaacctggtatcttagtatggaaacttagcatggaacctagtgccttagcatggaatcttatcatggaacctggtgtcttagcatggaatcttatcatggaacctggtgccttagcatggaaccttagcatggaaccctagcctggaacccggtgccttagcatggaatcttagcataaaacctggtgccttagcatgaagactggtgtctaattgcttaataaatgataaccactananna

SEQ ID NO: 65585 - DNA, 585 bp, Homo sapiens
acctagaaattctctcttaggagctgatcaaaatcaaactaagaaattttttacacatgtgagtcttggggacttcagggtcattcaaggcagaatcaggccataaatagtaatgccagagatgacaggatgtgtagagggacaggggaaaaatcttacagtgaaagaagagtaggggagtcttgaagtataagtcctttgggggtcagaggactttagagaagctgatgttgtaaaagaaaacagacttgtcacctctggcaaagcctcaacatatgggtatgtatccgtcagggttcagccagagaagcagaacaactggaagataattagaattatcagcctgtgccacccccatcatgtgtctctaaagaccccagactcagtcagtagaggggagatggcctgactttggggaggagacagcctgacttcagggaagaaatggcctgacttcgggacaaagacctcctgacttcaggggaagacaacgagcggcccttcccatcccctctccaactcccctctccgctgagagctgttttcatcactcaataaaattctctgcccccaccgtccttcaat

SEQ ID NO: 65586 - DNA, 349 bp, Homo sapiens
acctagaaattctctcttaggagctgatcaaaatcaaactaagaaattttttacacatggttcagccagagaagcagaacaactggaagataattagaattatcagcctgtgccacccccatcatgtgtctctaaagaccccagactcagtcagtagaggggagatggcctgactttggggaggagacagcctgacttcagggaagaaatggcctgacttcgggacaaagacctcctgacttcaggggaagacaacgagcggcccttcccatcccctctccaactcccctctccgctgagagctgttttcatcactcaataaaattctctgcccccaccgtccttcaat

SEQ ID NO: 65587 - DNA, 301 bp, Homo sapiens
ggaggcagaagttgcagtgagccgagatcatgccactgcactccagcctaggcgacagagcaagactctgtctcaaaaaataaacaaagacttaggccaataaaggtgaaactctggtaacattctctcttattcaaagctgaatcactgtcaggacagataaggatgaaaaattatgtactggaaatgtacgggagatcagcttctggaaaggagtttttaagaaaggaaacagtaatttaaaattgtcaaagacaactgtttagccaggtattttatacagataaaggggaatgaattc

SEQ ID NO: 65588 - DNA, 383 bp, Homo sapiens
acccgtgaaagccctgaattgatgtggttatgaaagcgcattggccaagctggctttccttcctctgacccccatctaactatggtgaacgccctcgttgggatgaggctcccaggctcctgatagcaggtagaggagagaacgagaccgcaaagagggaagccgagaggagtgatgaagaccctggccctaccatctactcaggctgtctttgcagccacactgtgagcccaggctggttaacgcttcctcctggaggagaaaagctaagagagaaaacaaaatccatgcagcgcgctccccctcggcccctcctctctgtctcctctgtgcgctaacctccaatgcctgcgggaaccaattacagtattctaatgagtgta

SEQ ID NO: 65589 - DNA, 435 bp, Homo sapiens
ggctaaagtgatctgcctgcctgccttggccttccgaagtgctggattacaggcataagccaccacgcctggcctgcattcttaacctctacattatactgcttctcaaaagtactaccaattatttttcttattctatttcttatttcctgaaatgagaattatttactttttacacatgctatgttttcaatagtcatcactactagtaattgattaaataaaattaagtccttttcaatttcaagattaagaaatggatagtttgtaacataactttaagggttgactaattagtaacaaatgcctgatgaatacatttgaagcaacactaaaatttgacttatagtttactttaccttttaaaacaaaagcatctaatagaaaaagcaggcaaaagactatacagcattacttgctaatgttaaatgtata

SEQ ID NO: 65590 - DNA, 317 bp, Homo sapiens
ggttggtgaatgatgcagtggagttggcacttgattaaatgtaatgaacatagtattgaaggctacagggttgatgactgttttgcctttgatcactgaaatgtggagaagcaaccttgacagagaacgtaaatacaatctatggattcaatttactcaacctgttgagtatcaaagtgcctaatctgtgggagtagagaggagacagtccaaatgctatagcttgaatgattttattatcaaaagcatcaagtttaaaaattcattaacttaaccctggtctatctatcacagttattaatttcctatccttggaa

SEQ ID NO: 65591 - DNA, 1568 bp, Homo sapiens
  misc_feature (932)..(933): n is a, c, g, or t
  misc_feature (1416)..(1416): n is a, c, g, or t
ctagaactcagaatcgaagtgtccactgtcatatgtcacatagtagacattagatagtagtaattgttaaactcttggagaacattgtagaattttaaaagctaaatgagaagttgatatgttatccagtgactgttactcaagttctgactataatggagtgaattttaaaaattaacagtttaaaaaaatagaaaaaaggaaatgtaacagaaaactgcagtattttaaaatatttctttatactgaagagatcagtgttagaagtgaggcctaaattatatgaagcagcaagtctgtctgattctgggcataattgccgaaagcaattcagaagaatcttcagattttgaatgtgaagaaagctttgacttaatgtttgtttatgatactaggggaaaatgatgaataaatgtatgcaattgtaggtgaataaaaagtatgcttttaaattatctattcattttggtaatgcttttgttaaatggaaggtggcacttacaactaaaggtttcttagaattgggggaatatggtatacttctctgagtgttatcaagttcaaatgttacaattcatatgaaagagcttagtacgataatggggaaaataatagtaacattgattataaaggcaacaaacttaatgattaagagtgaaagtcctggaatcagacttcttggattttaatcctgttaccaacacttaactaggtgtgtaactttgagtcagttactcagttaatgtcttattttcctcatttgttaaatgggtataatagtatgtgcctcaggttaaatgggcttaatgtgtaagtgcctagactagtacttggagtataggaaatgcttaatgagattcaatgtatgttatttgttatgaagctgtgaaacactgtgtatatgattttaaaatgtgctatttaaattcatnntttacagtttaacttgccattttaaaaagcaacatttgattactgattgaaaaaattttttggtctcatttgtgcagagcttatatttttctccttgcctaagctgttcttcatttgtttgtataaatattggcatgtttatttaccttggactagtccatgtcacctttcactaatcaaagctgttatttctgggttattaatcatcccacccaattgggtggcagcagtaaaccctgagggcttgccatctctcccactttataagttattactgtcattattgtttaaataattaaggagaggtttttttttgccaaattctttgctgtttggaaataaggaatggaacaagtaataaatatgctgaaaatatatgttttcttagttcactttaagaaattgatttatttaggaaatggtgtttgttttaaattacacttgatttttttgaaaaatttgtatgggcatatttcttaaaangttaggtctatagtataaaaagaattaaaacaccaaagatttctattgatttatattctttggttattcttttatatttcttgactggtattctgtatggttcccaaaaccagtcaagaactgtaaaactcttactctacatacttgccagc

SEQ ID NO: 65592 - DNA, 319 bp, Homo sapiens
ggtggatggttcagaaacgtcctgccctccaaccactttgtcagctctggaaacgcaaggcagaaagaatttcaaggccagactcccggagccctgagggccagctcttgcaacagacccaccaatgcagcacatctggacaaacacagcagcccaccatgtgctctccaccagcatctcacttctgcctcaccagagccttgaccctggggatactgtccctattttgcagacacagaaatggatgttactcagctgggaaggagaggaccccggacttaaccccagatgtcttagctccaaatccactctgcctcag

SEQ ID NO: 65593 - DNA, 435 bp, Homo sapiens
atatcagctttagcggtcgacaaagatttgaaattactggttcgaactgaacagtcctagcccagtgacgcaaatgacccaaggataaggttttcataggtttggcctgaacatacgcatttcctcctcctactcagtggttttaggtgagacagtctgagggtcttgaccggcacacccgttagggagagatgaagtaaaagagtttcacgctgcacttttacctgtctttaggatcctaattatcgttaaatggtttaatcaaatttttgtcctaaaaaagcataataggttagctgaccaatgattaaaacattatagatccggaacgaactagagaaggcatgcaaaattcagatgagaaagtttctaagtgatagctccagctgtcgacgcggccgcggtcgacgcggccgcgaatttagtagtagtaaa

SEQ ID NO: 65594 - DNA, 1476 bp, Homo sapiens
cttttattatgaggccaacattaccctgttaccaaagccagacaaagatattatgagaaaagaaaactacaaaccagtatcccttatgaacactgatgtaaaaattttcaacagaatactagcaaaccaaatttagcagcatattaaaaggattatacaccatgaccaaatggcatttattcccagactgcaagaatggttcaaaatgtgaaaatcaatcagtgtaatatatcatataaacagattgtagggggaaaaaaaccccacgtgatcatctgaatcgaagcagaaaaatcattttgacaaaattcaataccctttcatgacaaaaatcactgaacacataaggaataaaaagaaactacttcaacatagtaaaagccatatatgaaaaacccatagctaacatcttactggtgaaagaccaaaagcttttcctttaagattgaggatgagataaggatgcctgcttttcaccacttctattcaacatactactgaagttctagctagaccatttaggcaagaaaaagaaataaaaggcacacaaattggaaaggaagaggtaaaattatctctgttcatagatgatatgaccttgtagatagaaaatcctaaagatcccacaaaaaactatcaatgctaataactgaattaaacaaagtattggggcacaacgtgaatacacaaaaatccgttgcatttttatacacaaacaaacagtgaacaatctgaaaaggaaattacaaaaacaattccatccaaaagaataaaatacttaggaattaacaaggaggttaaaaacttaacaatgaaaagcagaaaaacattgctgaaagaaattaaaggcaacataaataagtggaaacatatcccatgttcgtgaactggaagatttaatattgttaagatgtcattacctacccaaaggcctctacagattcaatgcgttccctatcaaaatcgcaatgatgtttttttgcagaaaaggaaaaaaaaatctaaaatttatatggaatcttgagggactccaaatagctaaagttatcttgaaaaataacatagctggatgactcaatgtgctgatttcaaaatttgctaagaagctactgtgaccaaaacagtgtgttactggcataaagacagacatatagaccaatggaatcaacgggaaagtccagaagtaaaacctcacctatatggtcgaatgattttcgatgggggtgccaagacctttcaatggagaaagcacagtcaattcaacaaatggtgccaggacaactgggtatccatatgcaaaagaatgaagttggacctttatctaagtttgtatacaaaaatcaactcaaaatggatcaaagacctaaatgtaagaccccaaactataaaactcctagaaaacatagggcagaagcttcatgacattggatttgtcagtggtatcttgggaatgacaccaaaggaacaggcagctaa

SEQ ID NO: 65595 - DNA, 497 bp, Homo sapiens
ctcagcctctggaatagctgggactaacaggtgtgtgccaccacgtcctgctaatttatttttattttttgtagaaatgggggtctcactatgttactcaagcttgtcttgaactcctgggatcaagcaatcctcctgcctcagcctcccaaagtgctgggattacaggcatgagccatcggtggctggctttcaccctacctcttatctgtctgtcttatctatccatctatcatctaactccatttctgttgttttgttttgcttgaaccattttcagtagatgaaagacatcttgacctttctcccataaatacttgacagtttcctgcccaaatgcagtgccatgatcacccagggatttcacattaattcagcgatgtcatctaagattcagctcataatcagatttccctagttgtcataacattgatgtttctgaggagtccaggccagttgtcctatagactgtcccatcacctggatgtgtctgtttc

SEQ ID NO: 65596 - DNA, 1168 bp, Homo sapiens
actagaagaagatggatcttgaagaagaaaaaagatcagtttacctcattcaaccttcactgcaatcaaggaggaagctttatcatccctatctgacagaactgaggacatggctgaaggagattaaaagcacatttggaaataccgctttagatactctacaagttaaccttggaataaaccagactatcagagggcattgtcactcactgacggatttctttcattcctctctgctttggcattaggcagtcagccacatcaagagacttcataagaaacagccctgtaactcatttgttgctttcctgtaagaatgttgtcaaggacattatttacttcattacaaagggtcttctttgtgctggagaaacttctctcagatctctgtgccaggaagaatggtgtttctctcaaacactgggtttgatattacagatagtataaactatatatccaggcacatcctcctttagtgagtatatacaaactggcttcacttcatttttttcatcttccaacttctccataataatatttacttttaaaaatgttcttaacaatgaatatgaccaagacaatttgaggaaaccaatcataaactttgtgtcaatatagtaagcatgtttcctgcagggagataccactgttcccactaaaatagaacacaacaaaaggaggcaggagagaaatgaatgacttaggacctgtctaggttgaaaaggcaaactagaagtggggcacacctaacttgtttaaaaagactttgtcaactattatttgtgtactcttggcatttctgtgttctcctcattcctatttcattcctattcccctttaatatttcctttacatacctgataccttccctcccaaaaatggtgtgtgtctatgtagttccttgatgattttgtcaacgaataataaaccctgggttttggataaggaggtgaaaagaaagggctctgcttgattctgcacagggctatacaccacagggcgaggaaaaaaggaaaatccaaatatgtttagtcaggatgttttcctaaactattgaagaaatcttatctggcctcctcttaaaatatgtaagaactgtttccagctgcttgttatttggctgtgcttattttagaccaaagccaataaaaaaaatgagactcttaca

SEQ ID NO: 65597 - DNA, 539 bp, Homo sapiens
catttgctgaataaatgaatgaaccctcatcttctcttaacccacaccttataaaatctttctcaactactccaattttccctattacttttttttttaaactaatccctctgttcactctcaacactccttatttttcagtgtttggtgctttgaggggaaaacaaaatatgttcttcagttttacaatagttgggaaagaaaaaggagcatttttattgttttgtttcatctgtgttccttttctcttggattccacatggcatcatgtaatcaattttttgctgccttgcactgattgctcacagtctcatatgttgcttctccaaactaacaatgtgagtacagtgtctgtgtctccctcctctgtggcatatccaccccgctccatgaactgaaagcattccaattctgaggcactctgaactcttccataaaaagtggctattttcatggcctcttcgcaaagtgtaattctgtcttctctttcaagtaatattaataaaactagtttttaaaatttctttgacaaacattgt

SEQ ID NO: 65598 - DNA, 546 bp, Homo sapiens
aacgacctcactaaaggggatttggcccctcaaggccaagaattcggcccccaggtaaggcgggaaggcctactgggaaaatatgagctgcctggacagcttacggttggagtttatgaatttctataaagcaactttaaaacaatttttaaaaaatcactgaaacagccttttgtgttttcaaaaccagtattaaataggatcctgcatttaacgcactatttcttgcctggttcctttcctgaagtgcttctctttcctctttccaccgcgcccccactctagttggctagtagagaagatttttccagcttcagacaaaccacttttccaagaatacatggaacagattacagaagcaagtaacagcctgcttacttccccttctgcacttgtatgtacgttcagctggagttctgaaaagaggaagtcgggagaacatttttttctttttaaaagaaagattggagaaccacggagcacaagcaggtagaaatattgaaggaaagagaaagaagagaaaatggaaaaaatactgaaaaaaaa

SEQ ID NO: 65599 - DNA, 281 bp, Homo sapiens
atattctaactaaccacagtacctaaagtttggctaacttggttaattcacatagatgctacaaatattcattgtactttagcagcattttggtatacataagatggaagatacatggcatctgagagaatatttttactcttgaactattttctcctattttcagttatcgattcacttatccaattataaaattgtagccctgaaaggaaactgactttaagtgctaacgaaatttattactaaatatttattactaaatatttgaatatatttggttt

SEQ ID NO: 65600 - DNA, 402 bp, Homo sapiens
  misc_feature (43)..(45): n is a, c, g, or t
cgcggccgcgtcgaccgacagcttgaggagtttcatgaacttnnnatcatctggtggtccctagtctgaattcttgatagaaaataacctagtatgttcatgtatacatactgccaatttcaccgacagcttgaggagtttcatgaacttgccatcatctggtggtccctagtctgaattcttgatagaaaataacctagtatgttcatgtatacatatgtaactaacctgcacattgtgcacatgtacactaaaacttaaagtataataataataaaataaaaaaaaaagaaaagaacctagtgtgttaaaccttaaatgcccttagaaataacctagaccagtgtttcttaaactgtggtcatgagatcagttgaatggattatgaccaacattgaaaag

SEQ ID NO: 65601 - DNA, 659 bp, Homo sapiens
agtgtagaaacaagtgataaaatgcctattggaaagaaattttaggagtaaaatgtagcagtagacatcaggctgctatccttttttacccttcaacccagtgggtgatgtttctgggttacagactcaacagatggagttttaactatttatgtttaatcaaggaggaaaagaagccataatttgtatttaatgtagtagactatagaaatgaaagaataaagtgataccaaaatttcgtatattcaaatcaatcttatagttttataacattttaaccctaacattttattgtattttgggttgcaattactcatggcagatgaaagccatggcttctttttctagaaaaataaatgcacacatactgccaatttcaccgacagcttgaggagtttcatgaacttgccatcatctggtggtccctagtctgaattcttgatagaaaataacctagtatgttcatgtatacatatgtaactaacctgcacattgtgcacatgtacactaaaacttaaagtataataataataaaataaaaaaaaaagaaaagaacctagtgtgttaaaccttaaatgcccttagaaataacctagaccagtgtttcttaaactgtggtcatgagatcagttgaatggattatgaccaacattgaaaag

SEQ ID NO: 65602 - DNA, 777 bp, Homo sapiens
agctaaaattaagtttgccattccttctagagttctggcccaaggtgacttaaaaacagttttaataaacatttagaccatcatgtattttgtaatacagttgggtcactgttgattcctaagataaatgtgtttaaacagaagctttctcattcatcagcagcctcagctttcatccaaatttatttaatgatgatgcaagcccatagcgttggtgttgcagttcgtcaccatggaagtgtttctgtcaacaaatcctcgctttactatcatgaaattgattttgcaggggaaaggaggataattgtgaaagcttccttttattcttaaagatcttcacagtttgcctggatgtctaaatgaattgtatttaaaatcaataactggcaataaaattaaccacactaaattaacaattatgaggttagaaaaagggaaatggcaataagctactttgtctgaaatcggtcgttttggaatgtgacttggggaccatacttgtaatttaaatgttccctgaaagctgttgttctctgctcagaagtatggattatccccagggactcccatgaggcagatatcagaatttctaggaggattcggctgagttattctcatctatattgtaaatggcataataatcacagaagaaattcacactatattacttctttcaactaacatactgtattttttaaatatgccttttctatagcttatgttcataactatctttggcttttatttgcttgtttaaaaaaaactgtaagaggttaa

SEQ ID NO: 65603 - DNA, 435 bp, Homo sapiens
tgtgattagattcaggtgctggttgatgttaagttcctcacaggatatcacatctggaggcacacaaaggccgtcacaccaaggtgatgtcaattttggtcatctggtcaaggtgttgtcctattccttcactatatagttaccttttttctctgttgcaatgaataagcagtctgtgggaagaggagctgttacattttaaacagaaaatgtatttgacactgatggaaaggagaggaggaaaattaatgacataaatttcaaagcaactattaaattatttgattgcattcttcctcttttactgtctgccaaaattgataaaaaaaatttttctaataagaatgttttaaatagtgatatcttaataagcatcaaaattaagcctgagaaataaattctttccttcctaatttcctcctcagcaaaagtaat

SEQ ID NO: 65604 - DNA, 412 bp, Homo sapiens
ctgaagcagttataagaatatagacatattccactcagtcggagtgttcataaagcgatattaagcaccatactatatctcagcaacatgcatatgtttgaatggagttcatgaaagccatcatctaccacagtcattcatctggacttcaagtctgccctgctgggaagtaggtcaccacctctacactgggccactgtcaagatccaaaatgtgctaaaacttagtcaccactctatttggtagcaatccaaagtggaccaaaacatttcctaagtaataccaaggtcaaaaatataatgtcgatatgtcaaattttgatctctgtgagtggatactagtaaatggagagttgttatgagtaggatgagaggaaagttgttggttgtttcataaaagcaaagaaaattaa

SEQ ID NO: 65605 - DNA, 552 bp, Homo sapiens
ttttttttttttgaggctgcctaaaactttattagccacctactgtgtacagacactgggccacagcaataagcacagaacaggagtaggggcaggggaggagtctgcaagcttctgggaggaggggatcttgggagggaaccataaaatttacacattcactaaataacaagcgcttttgacatacaacgcaaaaaaaaaaaaaaggtgggggaccacttggatcaaaattttaagtcctcatcacataccttaagacacagttttagtccaatcaaaaatcataactgcattaaaaaattcaatgtagtgcaatcaaaccaaaaaacttaatttgtgatcataagtgctctactacataaacatcgatcatagcagggaacaaaaagttcaaatcacacagtacaaaaaaatctgtaaataaatataaactacagttcaagagaaatattaaattatacaattgcatcatactgttaacagcttattgaaatgaggtccataagaataaagggggttcctgttttggtgcttgacacttgaaattctaga

SEQ ID NO: 65606 - DNA, 4400 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65607 - DNA, 4181 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65608 - DNA, 3001 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcaagtgggaccgtaagaagaagcggtttgtgggacagtcaggacagt

SEQ ID NO: 65609 - DNA, 3785 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65610 - DNA, 4516 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggaggtgtgtctgagcttggctagaggctggaggcaagggctgacttgggaccggacacagaggccacgagtgtgctgtcatctcacccctgccctctctcaatcactttctcttctcagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65611 - DNA, 3514 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65612 - DNA, 3456 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgactgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65613 - DNA, 4168 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65614 - DNA, 3780 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgacggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65615 - DNA, 2641 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65616 - DNA, 2441 bp, Homo sapiens
atggtcttaggaccttcctgtgcaggaaccatggccgacctttccctttttgtacaagtgatctatttttttcactagcaaaaccatttaagatttctatataggatgtgctgtttgattagtttgacagataatcccccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65617 - DNA, 2260 bp, Homo sapiens
aacgctaggtcgaggctcggttgatcggccgagtgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65618 - DNA, 1446 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagtgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaagatgcatctcagaccccactttcccaggtatcacacgcggccgagttacatcc

SEQ ID NO: 65619 - DNA, 2165 bp, Homo sapiens
gcttcagctgcggctgggataacggaactctgtctgctggggcaggtggggaggagccttctcccatcccagggcttcacgcagcttccttaacgaggtttcccagctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65620 - DNA, 3271 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagaaaaaaaaaaactgaggcttatgccggtggggcaagaggtctgaaggcctgttagtgttctgacatttggcaaagggaactgcggtccaatggaggataattgaagcggaccgtaatggcgaaagaaaagagtgaaggggaacacaaagggcgagaaaaaaaacaatcgaaaggtatcaacatcaatagagagaacacaact

SEQ ID NO: 65621 - DNA, 4436 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtggtgagtgatcgagtgagccgcccctccatgctcgggggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65622 - DNA, 4289 bp, Homo sapiens
cttttcagtgcctttgtctccattgtcatttattctttctgaagtttgtgattgtcagaaaggcctccctgggctagtcctggcccaggactaccctggctcctacaggtatcccaagggtgctgcagaggagggctaaaattagggatttgtgcccaaaggtttaaggacgggagctgatagagatccatggaacctgggttctagttggggctggtagttctggggttagttgctgggggcactgtgggtggaaggcagctttgttgctatctggaacaacagaaggagtgaattgaggtctgtagttgagcccatctcttcagaggaactctgttgttaccattcttttgcatatttcagcttgtatctcttgtcagggcaatgcctttgcctcatacctcagcactggcctttcctcagttccaagccttgggtctgtgttcctggggatggggtgtgcagccttgcctggacatttggttatgggaagggaaaccaaagagacctgttctatcaagctaaccccttctctcctctctaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65623 - DNA, 3273 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65624 - DNA, 3949 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65625 - DNA, 2859 bp, Homo sapiens
ggtcccttatcagagctctaacgcctgtgctgggagatccgctgctgtctttagagctgccaagtatggacgtttaagttgctgaagctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtggtgagtgatcgagtgagccgcccctccatgctcgggggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65626 - DNA, 2769 bp, Homo sapiens
ggctggtacggtccgggatttaggatcagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65627 - DNA, 2510 bp, Homo sapiens
agcgtctggagagtgtatgtgactcaacccagggtcacagctgggtagggggaggggattggaaaccctccaggaggcccttgtccctgagccaggccccagtgctggcggcagtcctctgacctccgcactcccttttgagacctggactgcagggagaggtgaggagggatagggaagaagcctttattgagcgccaactgcatgccagacatggctgcactgctttcctttaatgctccaacaacctgacaagagggtcgggtgaggagacaggccccaagcggcagccggcactccaagggtttccctccacggcagccgtcccaactccctctcctgcaggggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65628 - DNA, 2121 bp, Homo sapiens
ttttttttttttgaggctgcctaaaactttattagccacctactgtgtacagacactgggccacagcaataagcacagaacaggagtaggggcaggggaggagtctgcaagcttctgggaggaggggatcttgggagtgatcccaacagctgagctccctgaatccctgtcccagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactagaactt

SEQ ID NO: 65629 - DNA, 310 bp, Homo sapiens
gcagagttgcacaaggagagaactcagcatggggggttggttctttgggttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatcaaaatggttgattttagtctttgctta

SEQ ID NO: 65630 - DNA, 1792 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttg

SEQ ID NO: 65631 - DNA, 3576 bp, Homo sapiens
  misc_feature (1)..(1): n is a, c, g, or t
naccaggctggcgtccggaattcccgggatccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac

SEQ ID NO: 65632 - DNA, 3781 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcagcagacctgagggagcgggatggggagggagctcggctgggaagtcactgggagcaggtaaaagccaggcatggtaggggcgcagagaggaaacgggacccaggaggccagctcaccacccagacaacctgggcacggctgccctagacctcatcctcaccctcccttctccgtaggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac

SEQ ID NO: 65633 - DNA, 3545 bp, Homo sapiens
gatgggggaaagggaggagaggggagaggcatttctgagtgttttagtggctctcaggttctcgctccacaactttccctgaagtccaaagccctgtggctcttgggtagaaaaggcagccaggtggcccagattctgggcactatcccagcttgtcgccaagcggttgtgtgatctcgggcaaatcgatccccgctctgggcttcacctcctcgtttctaagattccagggctggacccggtgattctcaggtccctgctggctctgacatgctgtggctctgtctctttcccagcacctgaattccgctactactcattcagggccatgtggcgcttgccagctctggacttcttgtttgtttttgagaaagtgtctcgctctgtcacccaggctggagttcagtggcgtgaccatagctcactgcagcctccaactccactcctgggttcaagcaatcctctcacctgagcttcccatgtagctgagactccaggtgtgcgccacccctcctggcatctctggacttctgatacccttaggtttggtttcttgggcctctctgctgccccagcacggccagtacttgcaggccttataagctgttctcttttctcctatcagacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac

SEQ ID NO: 65634 - DNA, 3533 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac

SEQ ID NO: 65635 - DNA, 1263 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctcccccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttg

SEQ ID NO: 65636 - DNA, 2712 bp, Homo sapiens
gcagagttgcacaaggagagaactcagcatggggggttggttctttgggttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac

SEQ ID NO: 65637 - DNA, 1193 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttg

SEQ ID NO: 65638 - DNA, 841 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtctggcctgagatgggatcctctagatcacctccca

SEQ ID NO: 65639 - DNA, 607 bp, Homo sapiens
tggggcagaggccagggtccccctgctgaggagctgggaaaagacagtagaagacttctaaggtagacggagagcgggtggagacgggggagaactggagaggaagccggggaggcagaggagagtagggcagggtaggagggggcatttgagacccaagacacgttttggtggcctgcccactactgaggctatctcaccctcttcttgctcagctctgggacattgggggacagccgcgtttccgcagcatgtgggagcgctactgccgaggagtgagcgccatcgtgtaagtacacgggaggcatcgccagactccagccttacccggcccccctagccctgctaccttcgaggacctcagaggcgcagggttttattagacataatccttggttcatgacacagtgtcggtccagggcctgcgtttattttgcatgccacttgtttcttattggataaatgccctgggcactcactacccaatctaagaaacagactatagactattaaccagccagatgcacctgtgcatcctcttcattgacttgtctccctcccctcaacccaaagtcaccactgtcttgaattttgtgtggtttaaatg

SEQ ID NO: 65640 - DNA, 3601 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac
